US008697398B2

(12) United States Patent
Doherty et al.

(10) Patent No.: US 8,697,398 B2
(45) Date of Patent: Apr. 15, 2014

(54) COMPOSITIONS AND METHODS FOR BACTERIAL PRODUCTION OF CHONDROITIN

(75) Inventors: Daniel H. Doherty, Boulder, CO (US); Craig A. Weaver, Boulder, CO (US); Kentaro Miyamoto, Higashiyamato (JP); Toshikazu Minamisawa, Higashiyamato (JP)

(73) Assignees: DSM IP Assets B.V., Heerlen (NL); Seikagaku Corporation, Tokyo (JP)

( * ) Notice: Subject to any disclaimer, the term of this patent is extended or adjusted under 35 U.S.C. 154(b) by 193 days.

(21) Appl. No.: 13/038,326

(22) Filed: Mar. 1, 2011

(65) Prior Publication Data

US 2011/0244520 A1 Oct. 6, 2011

Related U.S. Application Data

(60) Provisional application No. 61/309,407, filed on Mar. 1, 2010.

(51) Int. Cl.
| | | |
|---|---|---|
| C12P 19/26 | (2006.01) |
| C12N 9/00 | (2006.01) |
| C12N 1/20 | (2006.01) |
| C12N 15/00 | (2006.01) |
| C07H 21/04 | (2006.01) |

(52) U.S. Cl.
USPC ....... 435/84; 435/252.3; 435/320.1; 536/23.2

(58) Field of Classification Search
None
See application file for complete search history.

(56) References Cited

U.S. PATENT DOCUMENTS

| | | |
|---|---|---|
| 6,235,510 B1 | 5/2001 | Lark et al. |
| 6,890,739 B1 | 5/2005 | Hamamoto et al. |
| 7,273,729 B2 | 9/2007 | Narimatsu et al. |
| 7,354,741 B2 | 4/2008 | Sugahara et al. |
| 7,470,529 B2 | 12/2008 | Narimatsu et al. |
| 7,569,386 B2 | 8/2009 | DeAngelis |
| 7,598,068 B2 | 10/2009 | Ninomiya et al. |
| 7,723,092 B2 | 5/2010 | Ninomiya et al. |
| 8,283,145 B2 | 10/2012 | Suzuki et al. |
| 2003/0109693 A1 | 6/2003 | Ninomiya et al. |
| 2004/0005695 A1* | 1/2004 | Miksch et al. ............. 435/252.1 |
| 2006/0105431 A1 | 5/2006 | DeAngelis |
| 2006/0292671 A1* | 12/2006 | Schneider et al. ........... 435/69.1 |
| 2008/0125393 A1 | 5/2008 | DeAngelis |
| 2008/0219960 A1 | 9/2008 | Nierop Groot et al. |
| 2008/0280355 A1* | 11/2008 | Santurino et al. .......... 435/320.1 |
| 2009/0263867 A1 | 10/2009 | Sugiura et al. |
| 2009/0305357 A1 | 12/2009 | Ninomiya et al. |

FOREIGN PATENT DOCUMENTS

| | | |
|---|---|---|
| EP | 1 964 924 A1 | 9/2008 |
| WO | WO 00/27437 A2 | 5/2000 |
| WO | WO 03/012099 A1 | 2/2003 |
| WO | WO 03/029261 A2 | 4/2003 |
| WO | WO 2006/033693 A2 | 3/2006 |
| WO | WO2007069693 * | 6/2007 |
| WO | WO 2008/130373 A2 | 10/2008 |
| WO | WO2008133350 * | 11/2008 |
| WO | WO 2011/109438 A1 | 9/2011 |

OTHER PUBLICATIONS

Ninomiya et al. "Molecular Cloning and Characterization of Chondroitin Polymerase from *Escherichia coli* Strain K4" Journal of Biological Chemistry, vol. 277, No. 24, Issue of Jun. 14, pp. 21567-21575, 2002.*

Barnhill, J.G., et al., "Chondroitin Product Selection for the Glucosamine/Chondroitin Arthritis Intervention Trial," *J. Am. Pharm. Assoc.* 46:14-24, American Pharmacists Association, United States (2006).

Blatny, J.M., et al., "Improved Broad-Host-Range RK2 Vectors Useful for High and Low Regulated Gene Expression Levels in Gram-Negative Bacteria," *Plasmid* 38:35-51, Academic Press, United States (1997).

Cervigni, M., et al., "A combined intravesical therapy with hyaluronic acid and chondroitin for refractory painful bladder syndrome/interstitial cystitis," *Int Urogynecol J* 19:943-947, Springer-Verlag London Ltd., England (2008).

Cimini, D., et al., "Production of capsular polysaccharide from *Escherichia coli* K4 for biotechnological applications," *Appl Microbiol Biotechnol* 85:1779-1787, Springer International, Germany (Oct. 2010).

Deangelis P.L, and Padgett-McCue, A.J., "Identification and Molecular Cloning of a Chondroitin Synthase from *Pasteurella multocida* Type F," *The Journal of Biological Chemistry* 275(31):24124-24129, The American Society for Biochemistry and Molecular Biology, Inc., United States (2000).

Deangelis P.L, "Microbial glycosaminoglycan glycosyltransferases," *Glycobiology* 12:9R-16R, Oxford University Press, England (2002).

Domínguez-Cuevas, P., et al., "Roles of Effectors in XylS-Dependent Transcription Activation: Intramolecular Domain Derepression and DNA Binding," *Journal of Bacteriology* 190:3118-3128, American Society for Microbiology, United States (2008).

Glansdorff, N., et al., "Activation of Gene Expression by IS2 and IS3," *Cold Spring Harbor Symp. Quant. Biol.* 45:153-156, Cold Spring Harbor Laboratory Press, United States (1981).

Grozdanov, L., et al., "Analysis of the Genome Structure of the Nonpathogenic Probiotic *Escherichia coli* Strain Nissile 1917," *Journal of Bacteriology* 186:5432-5441, American Society for Microbiology, United States (2004).

Hochberg, M.C., and Clegg D.O., "Potential effects of chondroitin sulfate on joint swelling: a GAIT report," *Osteoarthritis and Cartilage* 16:S22-S24, Elsevier Ltd., England (2008).

(Continued)

*Primary Examiner* — Christian Fronda

(74) *Attorney, Agent, or Firm* — Sterne, Kessler, Goldstein & Fox P.L.L.C.

(57) ABSTRACT

The invention relates to the field of recombinant DNA technology for the production of chondroitin, including the production of chondroitin sulfate via a combination of recombinant bacterial fermentation and post-fermentation sulfation.

52 Claims, 55 Drawing Sheets

(56) References Cited

OTHER PUBLICATIONS

Kahan, A., et al., "Long-Term Effects of Chondroitins 4 and 6 Sulfate on Knee Osteoarthritis," *Arthritis & Rheumatism* 60:524-533, American College of Rheumatology, United States (Feb. 2009).

Mermod, N., et al., "Vector for Regulated Expression of Cloned Genes in a Wide Range of Gram-Negative Bacteria," *Journal of Bacteriology* 167:447-454, American Society for Microbiology, United States (1986).

Michel, B.A., et al., "Chondroitins 4 and 6 Sulfate in Osteoarthritis of the Knee: A Randomized, Controlled Trial," *Arthritis and Rheumatism* 52:779-786, American College of Rheumatology, United States (2005).

Möller, I., "Efficacy of Chondroitin Sulphate on Synovitis in Patients with Knee Osteoarthritis: An Ultrasound Study," *Osteoarthritis and Cartilage* 17 (Supplement 1):S32-S33, Elsevier B.V., Netherlands (Sep. 2009).

Nickel, J.C., et al., "A real-life multicentre clinical practice study to evaluate the efficacy and safety of intravesical chondroitin sulphate for the treatment of interstitial cystitis," *BJU International* 103:56-60, British Association of Urological Surgeons, England (Jan. 2009).

Ohtake, S., et al., "Human N-Acetylgalactosamine 4-Sulfate 6-O-Sulfotransferase cDNA Is Related to Human B Cell Recombination Activating Gene-associated Gene," *The Journal of Biological Chemistry* 276:43894-43900, The American Society for Biochemistry and Molecular Biology, Inc., United States (2003).

Petit, C., et al., "Region 2 of the *Escherichia coli* K5 capsule gene cluster encoding proteins for the biosynthesis of the K5 polysaccharide," *Molecular Microbiology* 17:611-620, Blackwell Science Ltd, England (1995).

Prydz, K., and Dalen K.T., "Synthesis and sorting of proteoglycans," *Journal of Cell Science* 113:193-205, The Company of Biologists Limited, Great Britain (2000).

Rimler, R.B., "Presumptive identification of *Pasteurella multocida* serogroups A, D and F by capsule depolymerisation with mucopolysaccharides," *The Veterinary Record* 134:191-192, British Veterinary Association, England (1994).

Roberts, I.S., "The Biochemistry and Genetics of Capsular Polysaccharide Production in Bacteria," *Annu. Rev. Microbiol.* 50:285-315, Annual Reviews Inc., United States (1996).

Rodriguez, M.-L., et at, "Structure and serological characteristics of the capsular K4 antigen of *Escherichia coli* O5 : K4 : H4, a fructose-containing polysaccharide with a chondroitin backbone," *Eur. J. Biochem* 177:117-124, FEBS, England (1988).

Townsend, K.M., et at, "Genetic Organization of *Pasteurella multocida* cap Loci and Development of a Multiplex Capsular PCR Typing System," *Journal of Clinical Microbiology* 39:924-929, American Society for Microbiology, United States (2001).

Uebelhart, D., et al., "Intermittent treatment of knee osteoarthritis with oral chondroitin sulfate: a one-year, randomized, double-blind, multicenter study versus placebo," *OsteoArthritis and Cartilage* 12:269-276, Elsevier Ltd., England (2004).

Volpi, N., "Quality of different chondroitin sulfate preparations in relation to their therapeutic activity," *Journal of Pharmacy and Pharmacology* 61:1271-1280, Royal Pharmaceutical Society of Great Britain, Great Britain (Oct. 2009).

Weickert, M.J., et al., "Optimization of heterologous protein production in *Escherichia coli*," *Current Opinion in Biotechnology* 7:494-499, Current Biology Ltd, England (1996).

Whitfield, C., "Biosynthesis and Assembly of Capsular Polysaccharides in *Escherichia coli*," Annu. Rev. Biochem. 75:39-68, Annual Reviews, United States (2006).

Yada, T., et al., "Chondroitin Sulfate Synthase-3: Molecular Cloning and Characterization," *The Journal of Biological Chemistry* 278:39711-39725, The American Society for Biochemistry and Molecular Biology, Inc., United States (2003).

Yasuda, S., et al., "A Novel Inhibitor of Ceramide Trafficking from the Endoplasmic Reticulum to the Site of Sphingomyelin Synthesis," *The Journal of Biological Chemistry* 276:43994-44002, The American Society for Biochemistry and Molecular Biology, Inc., United States (2001).

International Preliminary Report on Patentability for International Application No. PCT/US2011/026748, The International Bureau of WIPO, Switzerland, issued Sep. 4, 2012.

International Search Report and Written Opinion for International Application No. PCT/US2011/026748, The International Bureau of WIPO, Switzerland, mailed Jul. 20, 2011.

NCBI Entrez, GenBank Report, Accession No. AB079602, Ninomiya, T., et al., Entry Date Feb. 7, 2002.

* cited by examiner

Chondroitin Sulfate A    R = SO$_3$H    R' = H
Chondroitin Sulfate C    R = H          R' = SO$_3$H
Chondroitin              R = H          R' = H Gal = Galactose                      GlcUA = Glucuronic Acid
GalNAc = N-acetylgalactosamine       Xyl = Xylose

K4 putative ORF 1 with BcbE and EcbE

```
                         1                                                  50
K4 Kfo putORF_1     (1)  KIIPMAGSSRFFKAGYSKPYMLENGEFFDLC    LYFE  H
P mult seroB BcbE   (1)  MFMAS SRFPNAGYSKPKYQLMEQF    PC   SFE FPQ
P mult seroE EcbE   (1)  MFIIPMAG SSRFFKAGYNVEKYQLKQGKE  ES    SFE YEK F
         Consensus  (1)  MFIIPMAGLSSRFFKAGYSKPKYQL L  ESIF WAVKSFKKYF TDKFV
                         51                                                 100
K4 Kfo putORF_1    (51)  F LE          QRIASIGINSYT  TLDKE RGQ   VYIL SK FN
P mult seroB BcbE  (51)  F  RD   DTHQE EEQILQLGIHDYK   LP  ETLGQA VYG  YD D-
P mult seroE EcbE  (51)  F  KD          SE DKLGIDNYE IQL        TVYQG KN K-
         Consensus (51)  FIYRDVYNTKSFIL  I  LGI Y LICLPSETLGQAETVYQGI   I
                         101                                                150
K4 Kfo putORF_1   (101)      QP I FN    IRP   FI   EGEN CY             VK   DVK
P mult seroB BcbE (100)  S         IFN    L FQ     H      LEVF GA  MSF  A M ES
P mult seroE EcbE (100)          FK   D   SE    V DQ      EVF KNG  MSF      TN
         Consensus(101)  IDEEIYIFNIDSRI  NFIKPKWT  ECDGYLEVFKGDGDHWSFALPENS
                         151                                                200
K4 Kfo putORF_1   (151)  NE IA  EKKQISNL CTG Y  S----------------- R FISAY
P mult seroB BcbE (150)  L VI               CD   Y    S  QQ   D  A       N
P mult seroE EcbE (150)  R    AEK     QLCN  I    Y  EK   N  E    K
         Consensus(151)   KVIRTSEKERISDLCS GLYHFKNK  IF  LFI AK NNKTIKNEFYIA
                         201                                238
K4 Kfo putORF_1   (184)  EH Y   PQE -------W AG    SP IQLS -----
P mult seroB BcbE (200)            M       D        CGTPEEY SLLK-
P mult seroE EcbE (200)       D  Q        N         FFILW T---------
         Consensus(201)  PLYNNLIA NGIVFY LIDKDKIIF  N    N
```

K4 putative ORF 3 with BcbF and EcbF

```
                         1                                                  50
K4 Kfo putORF_3     (1)  MHY           LDK   FRLS K SH TPN K    KLY  L  Y  IF
P mult seroB BcbF   (1)  ---M          LDK  IK    GYR QF NS   KLR KA G  I  C
P mult seroE EcbF   (1)  ---M          LDK  I I    Y  K  N   KLQQYKKLG  I  S
         Consensus  (1)     MKRIIMDLDNTIT TENGDY NA PIK VIEKL EYK NGFEIVI S
                         51                                                 100
K4 Kfo putORF_3    (51)       KE  GK N        WLNENVF DEI GKPWC         FY
P mult seroB BcbF  (48)        Y  GK N        WLNR   VPDE Y GKPWCGHEGFY
P mult seroE EcbF  (48)           Y GK N I    PN  NW NQ  V              FY
         Consensus (51)  SRNMRTYEGNIGKINIHTLPLIIDWLN HNVPYDEIYVGKPWCGDDGFYV
                         101                            130
K4 Kfo putORF_3   (101)           S LC   L   S   LEQ  KCF-
P mult seroB BcbF  (98)           K   SS      K      E ---
P mult seroE EcbF  (98)              V    V  Q         EE-
         Consensus(101)  DDRAIRPDEF NLTYEEIKNITKIDKD
```

FIGURE 3B

1: T1387 of AB079602 is absent; Frameshift KfoG

2: a T is present between positions 1490 and 1491 of AB079602; Frameshift KfoG-Orf2

3: G2250 of AB079602 is an A; Missense KfoF S261L

4: C3265 of AB079602 is absent; Frameshift Orf1

5: G4858 of AB079605 is an A; Silent KfoE GCC → GCT

6: T4948 of AB079605 is an A; Missense KfoE R157S

7: T5025 of AB079602 is an A; Missense KfoE I132F

8: G5026 of AB079602 is a T; Silent KfoE GCC→GCA

9: C5028 of AB079602 is an A; Missense KfoE A131S

10: T5041 in AB079602 is an A; Missense KfoE E126D

11: G5049 in AB079602 is an A; Missense KfoE P124S

12: T5057 in AB079602 is an A; Missense KfoE K121I

13: T5068 in AB079602 is an A; Misense KfoE E117D

14: C5071 in AB079602 is an A; Misense KfoE E116D

15: A5890 in AB079605 is absent; Frameshift KfoD

16: G5921 in AB079605 is a T; Missense KfoD Q452K

17: T6021 in AB079602 is an A; Missense KfoD K418N

18: T6024 in AB079602 is an A; Missense KfoD E417D

19: C6183 in AB079602 is an A; Silent, KfoD GTG→GTT

20: C6593 in AB079602 is a T; Missense KfoD E228K

21: G11105 in AB079602 is a T; Missense KfoB H511N

22: G11111 in AB079602 is a T; Missense KfoB Q509K

23: G11341 in AB079602 is a T; Missense KfoB T432K

24: A12531 in AB079602 is a T; Missense KfoB D35E

25: T13434 in AB079602 is an A; silent KfoA GTA→GTT

26: G5200 in AB079602 is an A; silent KfoE ATC→ATT

FIGURE 4A Differences 1-26 in nucleotide sequences

KfoG and Orf2: Sequence differences 1 & 2 fuse Orf2 and KfoG into a single ORF.
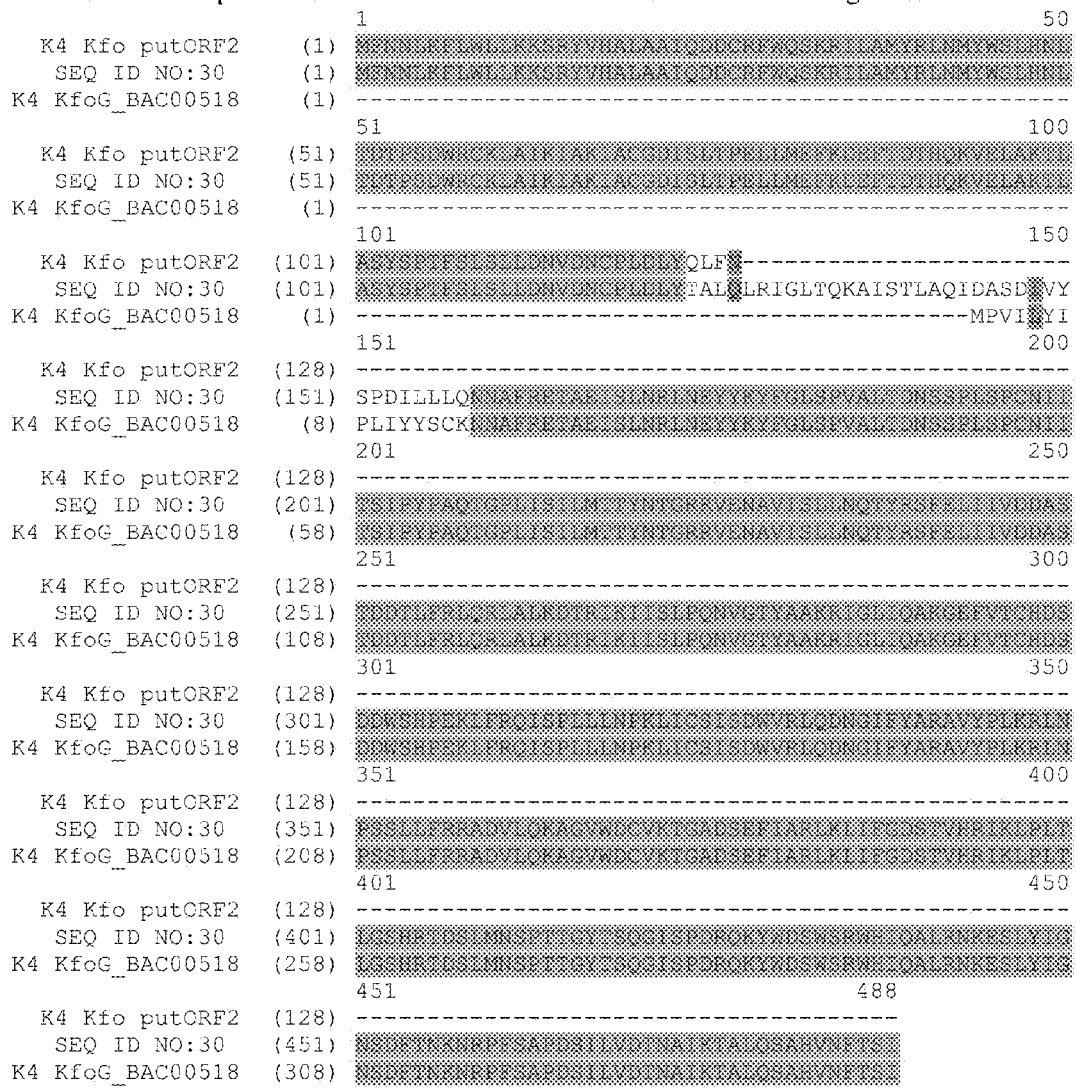
KfoF: Sequence difference 3 results in 1 amino acid difference in KfoF; S261L.
FIGURE 4B Differences in predicted protein amino acid sequences

Orf1: Sequence difference 4 results in extension of Orf1 coding sequence

```
                         1                                                  50
K4 Kfo putORF_1    (1)   [sequence]
SEQ ID NO:32       (1)   [sequence]
                         51                                                100
K4 Kfo putORF_1   (51)   [sequence]
SEQ ID NO:32      (51)   [sequence]
                         101                                               150
K4 Kfo putORF_1  (101)   [sequence]
SEQ ID NO:32     (101)   [sequence]
                         151                                               200
K4 Kfo putORF_1  (151)   [sequence]
SEQ ID NO:32     (151)   [sequence]
                         201                                      242
K4 Kfo putORF_1  (201)   V?NI?LSN--------------------------------
SEQ ID NO:32     (201)   I?IY?YLISNGIKVYYTEINKSDVIFCGTPREYENLQGKK
```

KfoE: Sequence differences 6, 7, 9, 10, 11, 12, 13 & 14 result in amino acid changes. Sequence differences 5 and 8 are silent.

```
                          1                                                 50
K4 KfoE_BAC00520    (1)   [sequence]
SEQ ID NO:26        (1)   [sequence]
                          51                                               100
K4 KfoE_BAC00520   (51)   [sequence]
SEQ ID NO:26       (51)   [sequence]
                          101                                              150
K4 KfoE_BAC00520  (101)   [sequence]
SEQ ID NO:26      (101)   [sequence]
                          151                                              200
K4 KfoE_BAC00520  (151)   [sequence]
SEQ ID NO:26      (151)   [sequence]
                          201                                              250
K4 KfoE_BAC00520  (201)   [sequence]
SEQ ID NO:26      (201)   [sequence]
                          251                                              300
K4 KfoE_BAC00520  (251)   [sequence]
SEQ ID NO:26      (251)   [sequence]
                          301                                              350
K4 KfoE_BAC00520  (301)   [sequence]
SEQ ID NO:26      (301)   [sequence]
                          351                                              400
K4 KfoE_BAC00520  (351)   [sequence]
SEQ ID NO:26      (351)   [sequence]
                          401                                              450
K4 KfoE_BAC00520  (401)   [sequence]
SEQ ID NO:26      (401)   [sequence]
                          451                                              500
K4 KfoE_BAC00520  (451)   [sequence]
SEQ ID NO:26      (451)   [sequence]
                          501            522
K4 KfoE_BAC00520  (501)   [sequence]
SEQ ID NO:26      (501)   [sequence]
```

FIGURE 4B (Continued)

Orf3: No sequence differences.

KfoD: Sequence difference 15 results in truncation of KfoD.
Sequence differences 16, 17, 18 & 20 result in amino acid substitutions.
Sequence difference 19 is silent.

```
                              1                                                    50
K4 KfoD_BAC00521    (1)    [sequence]
SEQ ID NO:24        (1)    [sequence]
                              51                                                   100
K4 KfoD_BAC00521   (51)    [sequence]
SEQ ID NO:24       (51)    [sequence]
                             101                                                   150
K4 KfoD_BAC00521  (101)    [sequence]
SEQ ID NO:24      (101)    [sequence]
                             151                                                   200
K4 KfoD_BAC00521  (151)    [sequence]
SEQ ID NO:24      (151)    [sequence]
                             201                                                   250
K4 KfoD_BAC00521  (201)    [sequence]
SEQ ID NO:24      (201)    [sequence]
                             251                                                   300
K4 KfoD_BAC00521  (251)    [sequence]
SEQ ID NO:24      (251)    [sequence]
                             301                                                   350
K4 KfoD_BAC00521  (301)    [sequence]
SEQ ID NO:24      (301)    [sequence]
                             351                                                   400
K4 KfoD_BAC00521  (351)    [sequence]
SEQ ID NO:24      (351)    [sequence]
                             401                                                   450
K4 KfoD_BAC00521  (401)    [sequence]
SEQ ID NO:24      (401)    [sequence]
                             451                                       488
K4 KfoD_BAC00521  (451)    [sequence]ASKNIARTNTFFAGMSYLLQGIDIT
SEQ ID NO:24      (451)    [sequence]PRKISLEQILSLRE-----------
```

IS2: No sequence differences.

KfoC: No sequence differences.

FIGURE 4B (Continued)

KfoB: Sequence differences 21, 22, 23 & 24 result in amino acid substitutions.

KfoA: Sequence difference 25 is silent.

FIGURE 4B (Continued)

U1-41 K4 cluster

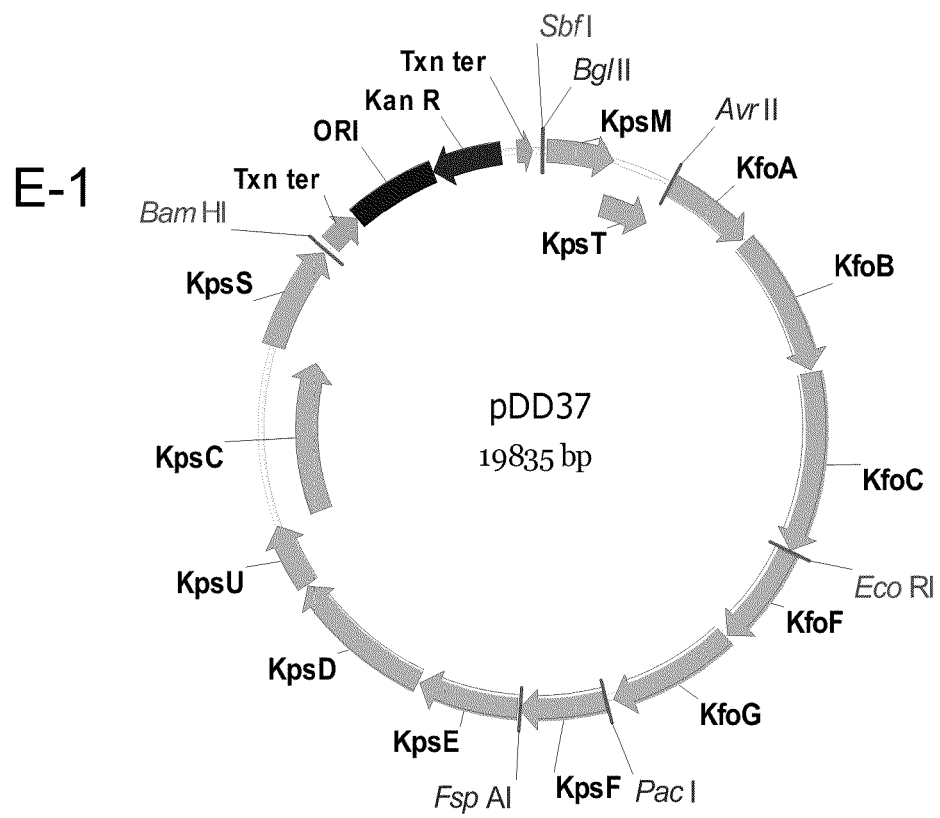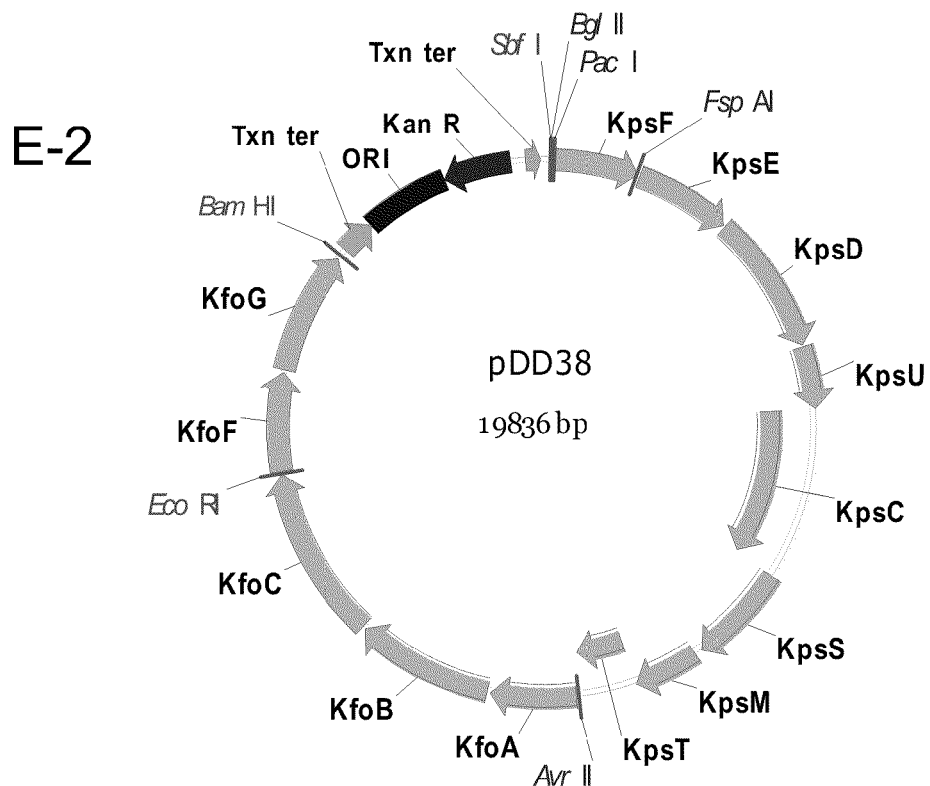
FIGURE 8E

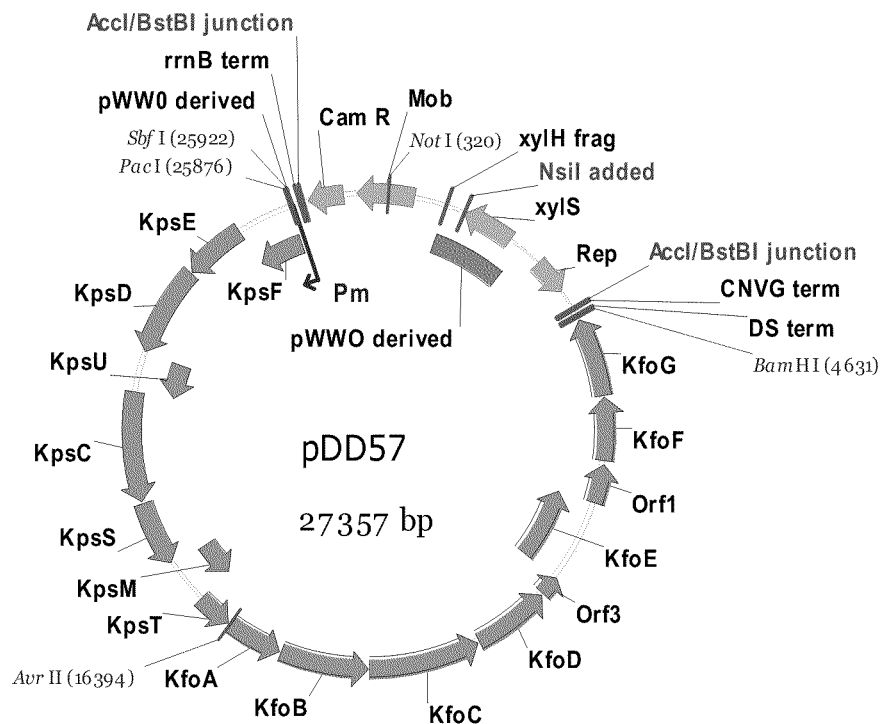
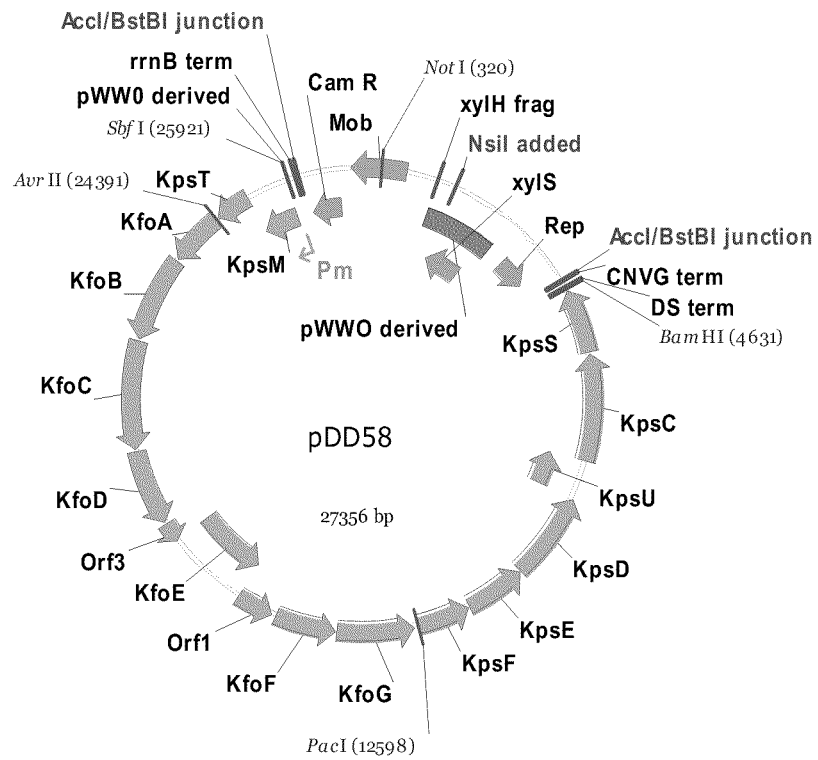
FIGURE 8G

J-1
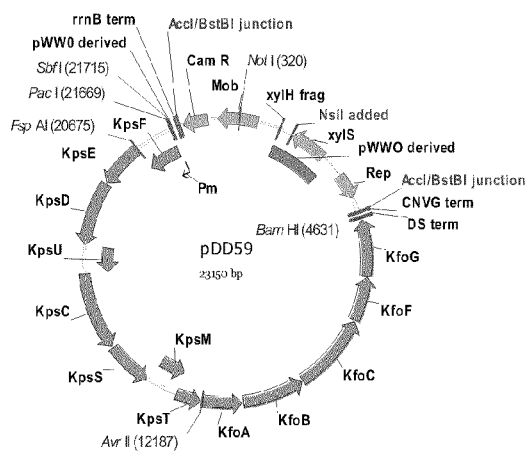
J-2
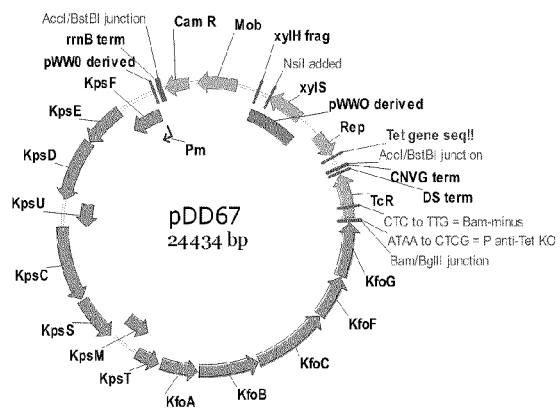
J-3
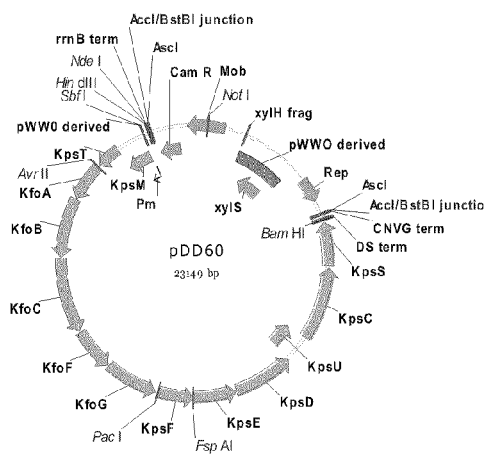
J-4
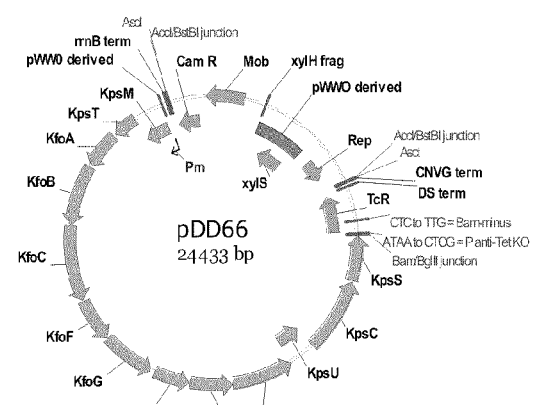
FIGURE 8J

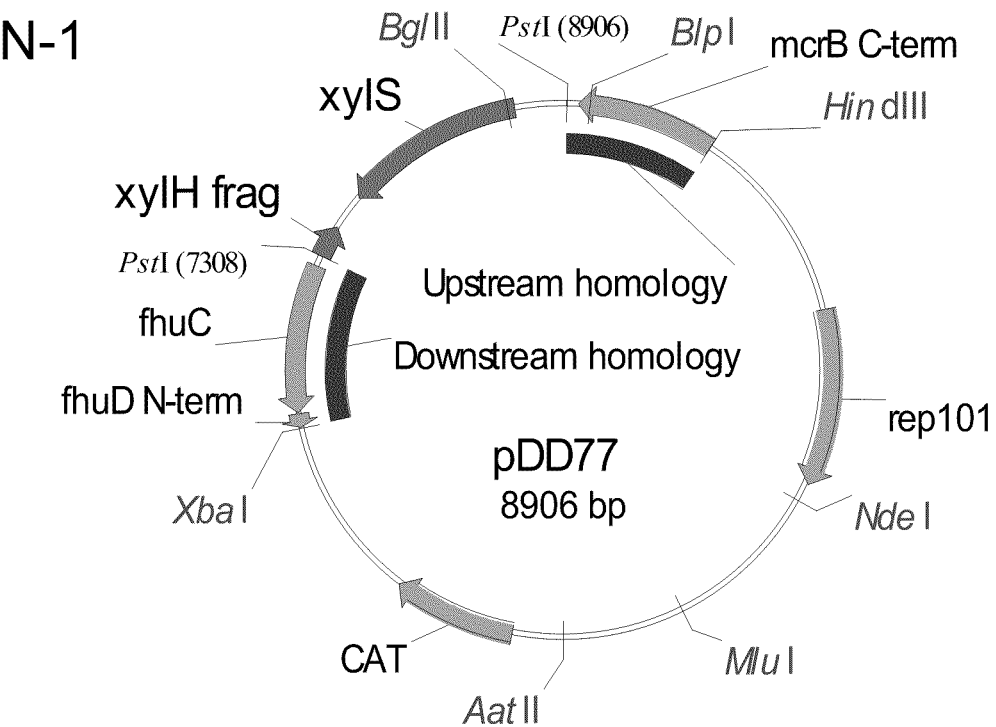
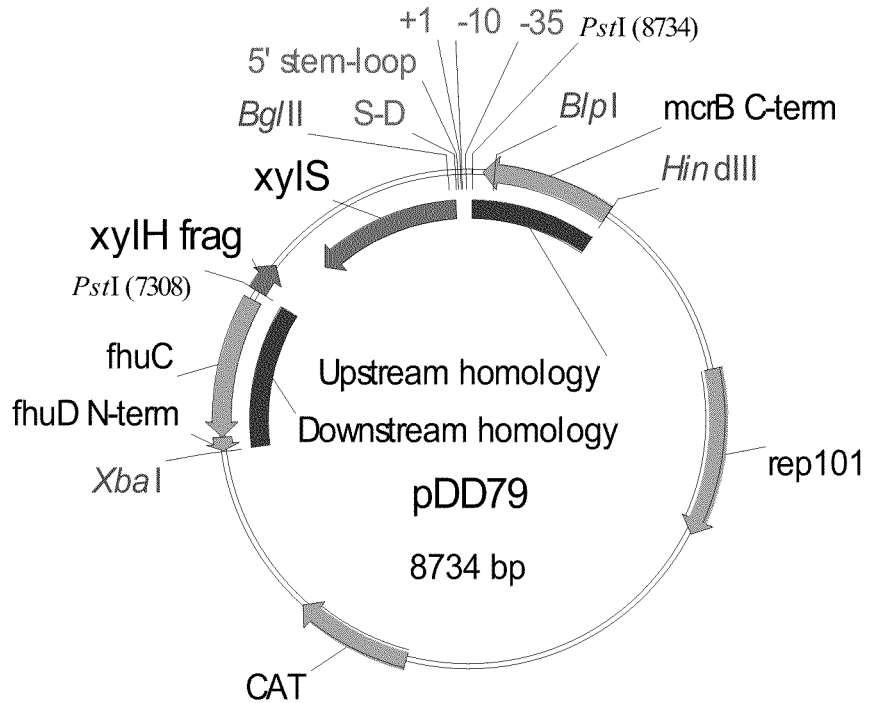
FIGURE 8N

S-1
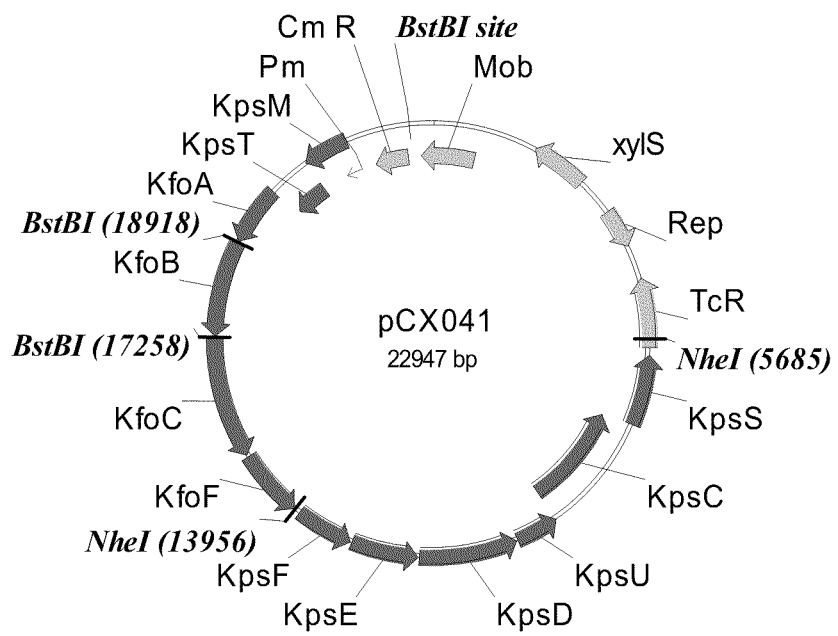
S-2
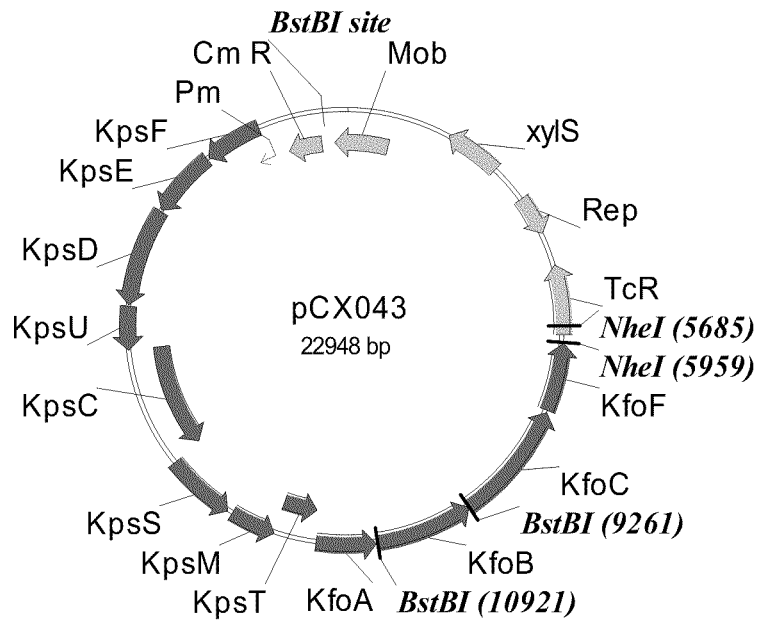
FIGURE 8S

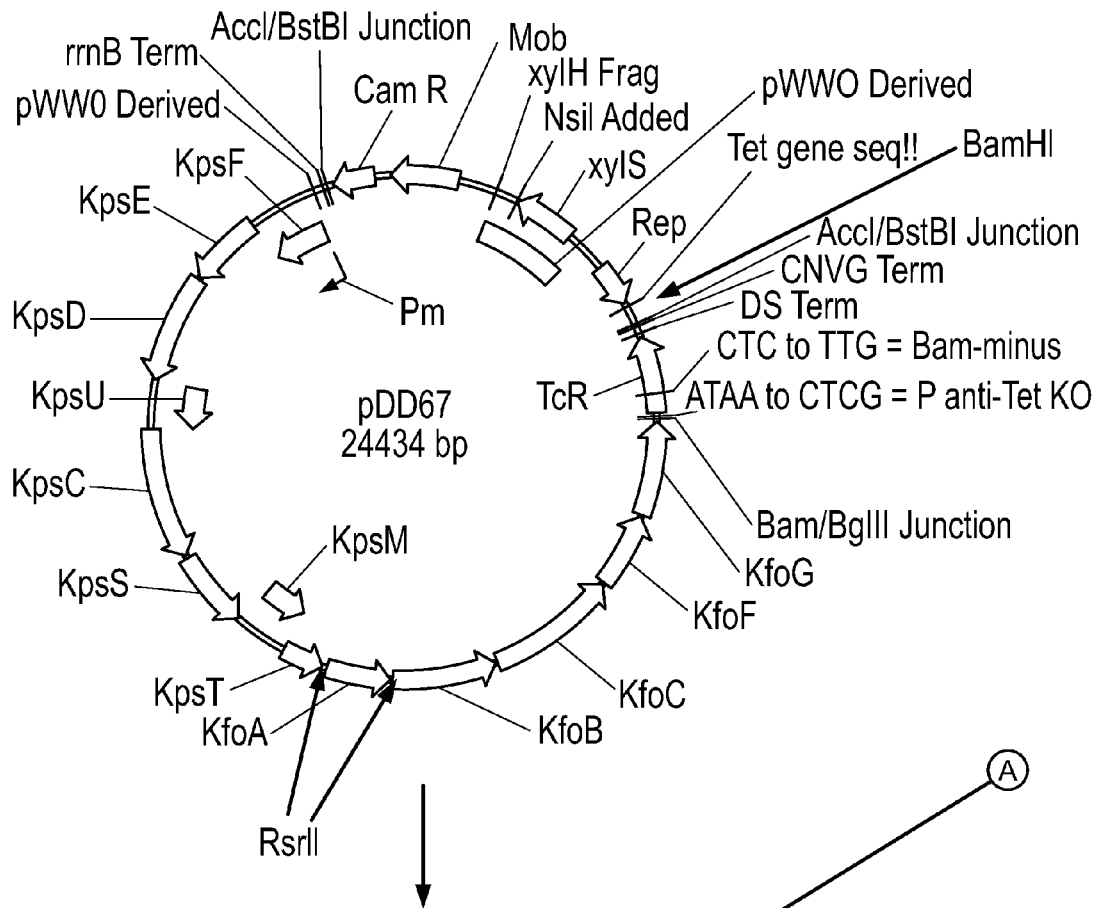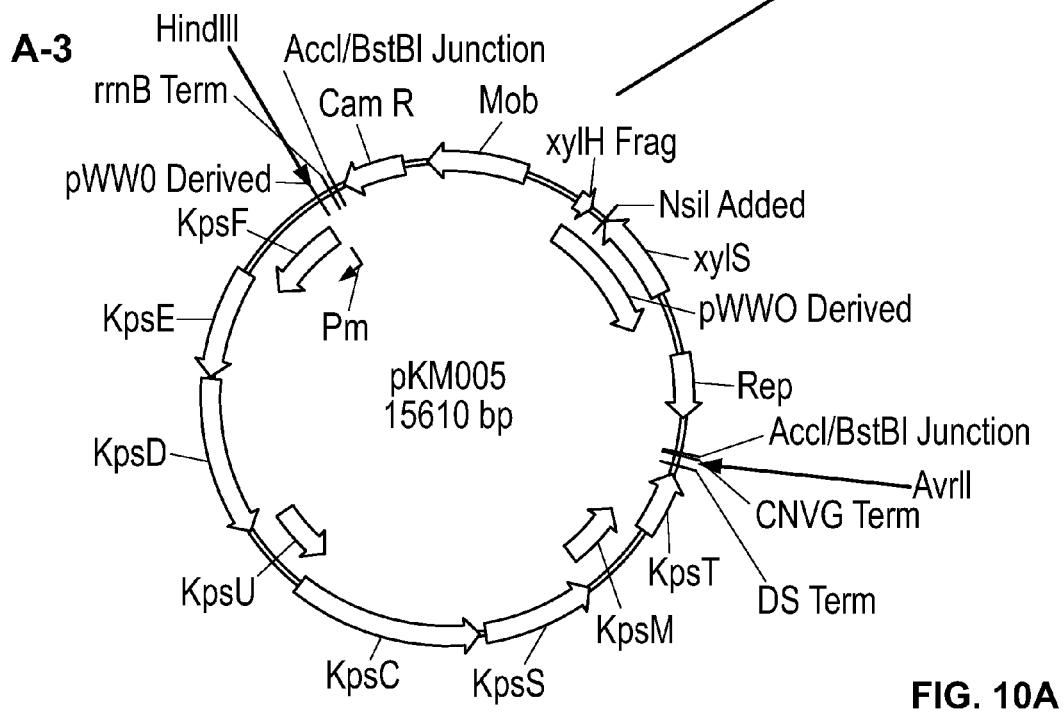
FIG. 10A

A-2
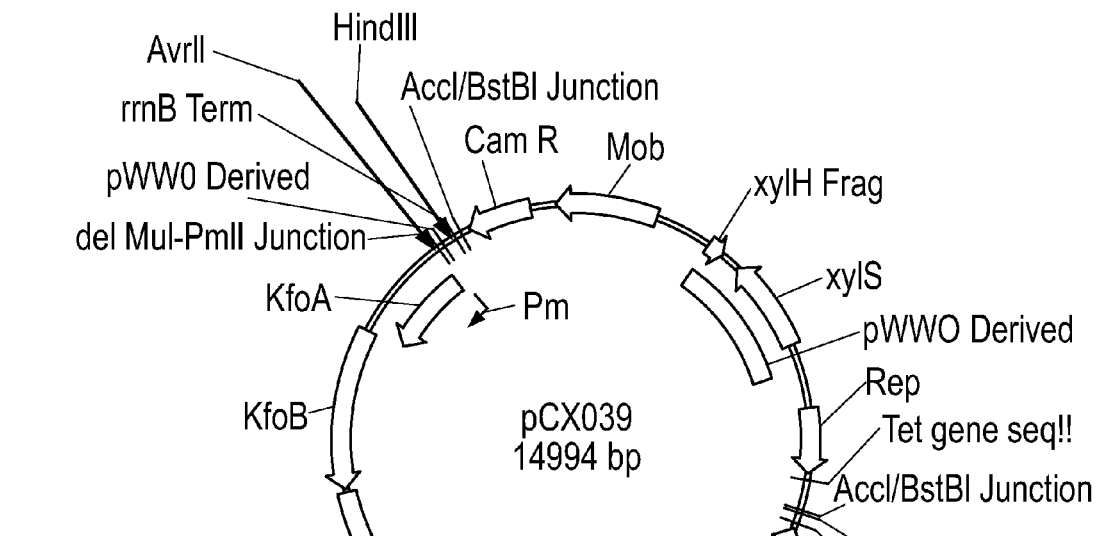
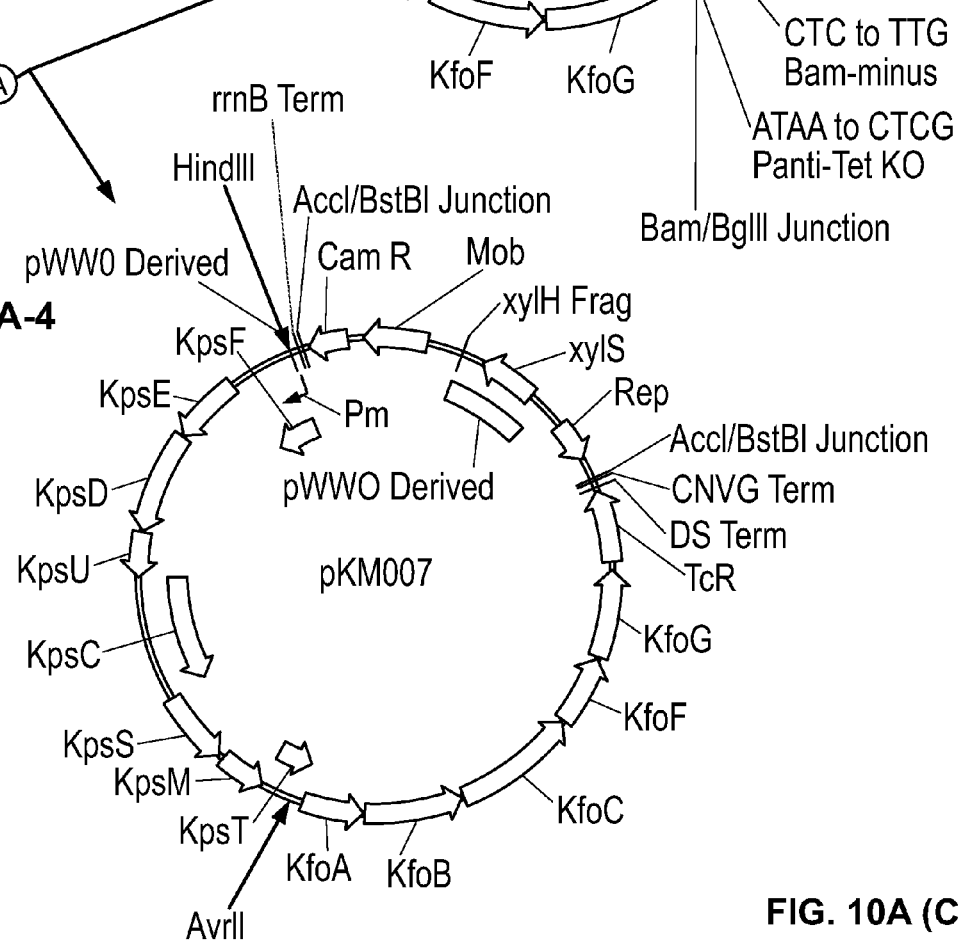
A-4
FIG. 10A (Cont.)

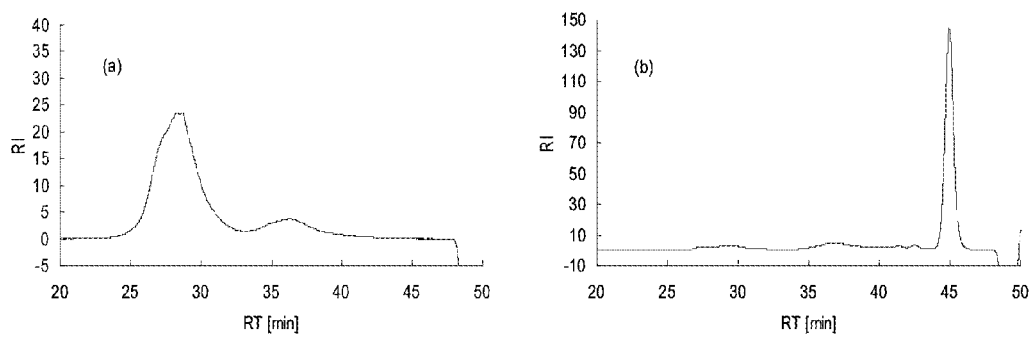
FIGURE 12 SEC-HPLC profiles of recombinant chondroitin (rCH) before and after C-ABC digestion.(a) rCH before digestion and (b) rCH after C-ABC digestion.

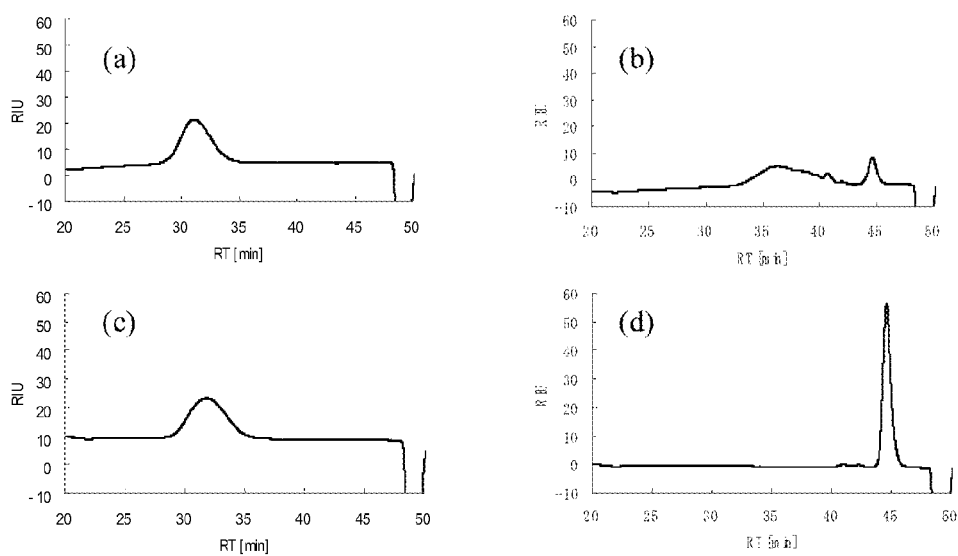
FIGURE 13 SEC-HPLC profiles of K4P and DFK4P before and after C-ABC digestion. (a) K4P before digestion, (b) K4P after C-ABC digestion, (c) DFK4P before digestion and (d) DFK4P after C-ABC digestion

**Family Tree of E. coli Chondroitin-Producing Strains

COMPOSITIONS AND METHODS FOR BACTERIAL PRODUCTION OF CHONDROITIN

CROSS-REFERENCE TO RELATED APPLICATION

This application claims the benefit of the filing date of U.S. Appl. No. 61/309,407, filed Mar. 1, 2010, which is hereby incorporated by reference herein in its entirety.

REFERENCE TO SEQUENCE LISTING

The content of the electronically submitted sequence listing ("sequencelisting_ascii.txt", 902,707 bytes, created on Mar. 1, 2011) filed with the application is incorporated herein by reference in its entirety.

BACKGROUND OF THE INVENTION

1. Field of the Invention

The invention relates to the field of recombinant DNA technology for the production of chondroitin, including the production of chondroitin sulfate via a combination of recombinant bacterial fermentation and post-fermentation sulfation.

2. Background Art

Chondroitin belongs to a family of heteropolysaccharides called glycosaminoglycans (GAGs). Glycosaminoglycans (GAGs) are unbranched, negatively charged polysaccharide chains composed of repeating disaccharide units, one of which is an acidic sugar and the other of which is an amino sugar (N-acetylglucosamine or N-acetylgalactosamine), that can be sulfated. Because of their inflexible nature and high negative charge, GAGs exhibit highly extended conformations occupying large amounts of space, attracting cations and water and forming porous gels in the extracellular matrix. As such, GAGs, which are found in most animals, help to hydrate and expand tissues and enable the matrix to withstand compressive forces. The cartilage matrix lining the knee joint, for example, can support pressures of hundreds of atmospheres by this mechanism.

Chondroitin sulfate is important for maintenance of cartilage strength and resilience and is marketed as a nutritional supplement to reduce joint pain and promote healthy cartilage and joint function. Clinical studies support the use of chondroitin sulfate for treatment of osteoarthritis (See, for example, Kahan et al., *Arthritis and Rheumatism* 2009; 60:524-533; Michel et al., *Arthritis and Rheumatism* 2005; 52:779-786 and Uebelhardt et al., *Osteoarthritis and Cartilage* 2004; 12:269-276), interstitial cystitis (See, for example, Nickel et. al., *BJU Int.* 2009; 103:56-60 and Cervigni et al., *Int. Urogynecol. J. Pelvic Floor Dysfunct.* 2008; 19:943-947), and synovitis (See, for example, Hochberg and Clegg, *Osteoarthritis and Cartilage* 2008; 16(Suppl. 3):S22-S24 and Möller, *Osteoarthritis and Cartilage* 2009; 17(Suppl. 1):S32-S33). These documents are incorporated by reference herein in there entireties.

Chondroitin sulfate is currently produced by extraction from cartilage of animals including cows, pigs, sharks and poultry, using chemical and enzymatic treatments to dissociate the polysaccharide from the protein and produce a polysaccharide product of varying quality (Barnhill et al., *J. Am. Pharm. Assoc.* 2006; 46:14-24, Volpi, *J. Pharm. Pharmacol.* 2009; 61:1271-1280).

Chondroitin contains D-glucuronic acid (GlcUA) and N-acetyl-D-galactosamine (GalNAc). It is composed of a disaccharide repeating unit β3GalNAc-β4GlcUA. Typically, the GalNAc residues are variably sulfated at the 4 and 6 positions. Chondroitin sulfate occurs naturally as a component of proteoglycans that are structural components of cartilaginous tissue, such as joints, in humans and other animals. Proteoglycans consist of a core protein and a polysaccharide component, such as chondroitin sulfate, which is covalently attached to the protein through an oligosaccharide linker as shown in FIG. 1. The core protein is decorated with multiple polysaccharide chains. Proteoglycans can be anchored in the cell membrane with the polysaccharide-containing portion of the protein present in the extracellular space or can be secreted and localized in the extracellular matrix (Prydz and Dalen, *J. Cell Sci.* 2000; 113:193-205).

The glycosyltransferase enzymes responsible for synthesizing the chondroitin backbone (chondroitin synthases) do so by adding alternating monosaccharide units of GalNAc and GlcUA from UDP-GalNAc and UDP-GlcUA donors to an accepting substrate. Theses enzymes have been identified in humans (Kitagawa et al., *J. Biol. Chem.* 2001; 276:43894-43900; Yada et al., *J. Biol. Chem.* 2003; 278:39711-39725), and homologs of human chondroitin synthase have been identified in a variety of other animals including horse, cow, rodents, dog, chicken, zebra fish, nematodes, and insects (www.ncbi.nlm.nih.gov/homologene/8950).

Some bacteria also produce chondroitin or chondroitin-like polysaccharide polymers as a component of their capsule. Unlike the chondroitin sulfate found in vertebrates, microbial chondroitin is not present as a proteoglycan, but rather as a lipid-linked polysaccharide on the bacterial cell surface and as free (i.e., not cell-associated) polysaccharide in culture media (Whitfield, *Annu. Rev. Biochem.* 2006; 75:39-68; DeAngelis, *Glycobiol.* 2002; 12:9R-16R).

Two bacteria, *E. coli* K4 (Rodriguez et al., *Eur. J. Biochem.* 1988; 177:117-124) and *Pasteurella multocida* serotype F (Rimler, *Vet. Rec.* 1994; 134:191-192), were reported to produce non-sulfated, chondroitin-like, capsular polysaccharides that potentially could be chemically modified to produce chondroitin sulfate. *E. coli* K4 was shown by Rodriguez et al. to produce an unsulfated chondroitin backbone with fructose side branches (K4 antigen) as a capsular polymer component. Ninomiya et al. (*J. Biol. Chem.* 2002; 277:21567-21575) identified and sequenced key genes required for biosynthesis of the chondroitin-like capsular polysaccharide in *E. coli* K4. These sequences were deposited with GenBank™ having accession number AB079602. The sequences disclosed by Ninomiya et al. comprise the so-called "region 2" portion of the "group 2" capsule gene cluster of *E. coli* K4. A detailed description of the organization of capsule gene clusters in *E. coli* is provided by Whitfield (*Annu. Rev. Biochem.* 2006; 75:39-68). The region 2 genes of *E. coli* group 2 capsule gene clusters encode the proteins that determine the structure of the capsular polysaccharide. The AB079602 sequence includes a gene, termed kfoC, that encodes the *E. coli* K4 chondroitin polymerase. The *E. coli* K4 chondroitin polymerase is a bifunctional glycosyltransferase that transfers GlcUA and GalNAc alternately to the non-reducing end of a chondroitin saccharide chain and related oligosaccharides, producing the chondroitin backbone of the K4 antigen polysaccharide. The chondroitin-like capsule polysaccharide produced by *E. coli* K4 contains fructose, linked (β1,3) to the GlcUA residues of chondroitin. *Pasteurella multocida* Type F also produces an unsulfated chondroitin capsule component and the glycosyltransferase responsible for chondroitin polymerization in this organism has also been cloned, as reported in DeAngelis & Padgett-McCue, *J. Biol. Chem.* 2000; 275:24124-29. Like the K4 chondroitin polymerase, the *Pas-*

*teurella* chondroitin synthase (pmCS, Genbank Accession No. AAF97500) is a single polypeptide enzyme that can synthesize a chondroitin polymer from UDP-GlcUA and UDP-GalNAc when provided with an appropriate acceptor substrate.

Traditional methods of chondroitin sulfate production involving purification from animal tissue can be laborious and cost intensive. Moreover, production of chondroitin sulfate from animal tissue is necessarily associated with the potential for infectious agents to be present in the chondroitin sulfate products. Care must be taken during production from animal tissues to minimize the likelihood of such potential infectious agents. Such shortcomings can be addressed by using alternative approaches utilizing recombinant DNA technology for production of chondroitin. Recently, microbial production of chondroitin has been suggested by DeAngelis (US Patent Application Publication No. 20030109693) and by Cimini et al. (*Appl. Microbiol. Biotechnol.* 2010; 85(6):1779-87 (Epub Oct. 1, 2009)). However, the known microorganisms that produce chondroitin (*Pasteurella multocida*) or chondroitin-like (*E. coli* K4) polysaccharides are known pathogens to various mammals and therefore unsuitable for large scale fermentation. They are also relatively low producers of the polysaccharide.

In particular, *P. multocida* is considered not suitable for commercial production of chondroitin because of its low yield, requirement of expensive media, and Biohazard Level 2 (BL2) status, which requires specialized and expensive facilities. High yields from a microorganism would be necessary for commercially profitable production of chondroitin. DeAngelis (US Patent Application Publication No. 20030109693) mentions the possibility of expressing pmCS in host cells such as a food grade *Lactococcus* or *Bacillus* to synthesize recombinant chondroitin. However, *Bacillus* is a gram positive bacterium and, as such, has a very different membrane/cell wall structure than gram negative organisms like *E. coli* and *Pasteurella multocida*. Efficient secretion of the polymer would, therefore, be expected to be problematic in *Bacillus*.

*E. coli* K4 is also unsuitable for production of chondroitin because it is known to be a human pathogen. Moreover, it does not produce chondroitin per se, but instead produces, as noted above, a fructosylated form of chondroitin. Extensive chemical or enzymatic modification of this polysaccharide is required to produce chondroitin. Such modification increases the total cost of the process. Additionally, it requires introduction of further processes and quality control measures to determine that such modification was complete and generated a consistent product.

There is a need, therefore, for an efficient, safe and cost effective process for the production of chondroitin. The present invention addresses this need by providing constructs and host cells and methods for recombinant microbial production of chondroitin which can subsequently be sulfated to produce chondroitin sulfate.

BRIEF SUMMARY OF THE INVENTION

The present invention is directed to a construct comprising a gene cluster comprising kpsF, kpsE, kpsD, kpsU, kpsC, kpsS, kfoA, kfoC, and kfoF, wherein the gene cluster does not contain a functional gene of one or more of kfoD, orf3 (kfoI), kfoE, or orf1 (kfoH), and wherein the construct is suitable for producing a chondroitin in a non-pathogenic bacterial host cell. In some embodiments, the chondroitin is non-fructosylated. In some embodiments, the chondroitin is secreted from the host cell. In some embodiments, the gene cluster further comprises kfoG, kfoB, or both kfoG and kfoB. In some embodiments, the gene cluster further comprises kfoM and kfoT. In some embodiments, the construct comprises pDD66, pDD67, pCX040, pCX041, pCX042, pCX043, pCX096, or pBR1052.

The present invention is directed to a construct comprising a gene cluster comprising kfoA, kfoC, and kfoF, wherein the gene cluster does not contain a functional gene of one or more of kpsM, kpsT, kpsE, kpsD, kpsC, or kpsS, and wherein the construct is suitable for producing a chondroitin in a non-pathogenic bacterial host cell. In some embodiments, the chondroitin is not secreted from the host cell. In some embodiments, the construct also does not contain a functional gene of one or more of kfoD, orf3, kfoE, or orf1. In some embodiments, the chondroitin is non-fructosylated. In some embodiments, the gene cluster further comprises kfoG, kfoB, or both kfoG and kfoB. In some embodiments, the construct comprises kfoA, kfoB, kfoC, kfoF, and kfoG. In some embodiments, the construct comprises pCX039, pCX044, or pCX092. In some embodiments, the construct comprises pCX045 or pCX048.

The present invention is directed to a construct comprising a gene selected from the group consisting of kfoA, kfoB, kfoC, kfoF, kfoG, and a combination thereof, wherein the construct does not contain a functional gene of one or more of kpsM, kpsT, kpsE, kpsD, kpsC, or kpsS, and wherein the construct is suitable for producing a chondroitin or increasing the amount of a chondroitin in a non-pathogenic bacterial host cell. In some embodiments, the chondroitin is not secreted from the host cell. In some embodiments, the construct also does not contain a functional gene of one or more of kfoD, orf3, kfoE, or orf1. In some embodiments, the chondroitin is non-fructosylated. In some embodiments, the construct comprises kfoA, kfoB, kfoC, kfoF, and kfoG. In some embodiments, the construct comprises pCX075, pCX081, pCX082, pCX092, pCX101, pBR1102, pBR1100 or pBR1101. In some embodiments, the construct comprises pCX045 or pCX048.

In some embodiments, one or more genes in any of the constructs of the invention are modified for optimal codon usage in the bacterial host cell.

In some embodiments, any of the constructs of the invention further comprise a promoter. In some embodiments, the promoter is selected from the group consisting of Pm, Plac, Ptrp, Ptac, λpL, PT7, PphoA, ParaC, PxapA, Pcad, and PrecA. In some embodiments, the promoter is Pm.

In some embodiments, any of the constructs of the invention further comprise a second promoter. In some embodiments, the second promoter is selected from the group consisting of Pm, Plac, Ptrp, Ptac, λpL, PT7, PphoA, ParaC, PxapA, Pcad, and PrecA. In some embodiments, the second promoter is Pm. In some embodiments, the second promoter is operably linked to one or more genes in the construct. In some embodiments, the second promoter is operably linked to kpsFEDUCS.

In some embodiments, the construct further comprises a xylS regulatory gene.

In some embodiments, any of the constructs of the invention further comprise an antibiotic resistance gene. In some embodiments, the antibiotic resistance gene is selected from the group consisting of chloramphenicol (CamR), kanamycin (KanR), ampicillin (AmpR), tetracycline (TetR), bleomycin (BleR), spectinomycin (SpcR), sulfonamide (SuR), streptomycin (StrR), carbenicillin (CbR), and erythromycin (EryR).

In some embodiments, any of the constructs of the invention comprise a K4 gene cluster.

In some embodiments, any of the constructs of the invention are suitable for producing a chondroitin in a non-pathogenic bacterial host cell, wherein the bacterial host cell is or is derived from a non-pathogenic organism selected from the group consisting of *Escherichia, Pseudomonas, Xanthomonas, Methylomonas, Acinetobacter,* and *Sphingomonas*.

The present invention is directed to a non-pathogenic bacterial host cell comprising any of the constructs of the invention. In some embodiments, the bacterial host cell is or is derived from a non-pathogenic organism selected from the group consisting of *Escherichia, Pseudomonas, Xanthomonas, Methylomonas, Acinetobacter,* and *Sphingomonas*. In some embodiments, the bacterial host cell is a bacterial strain selected from the group consisting of MSC279, MSC280, MSC315, MSC316, MSC317, MSC319, MSC322, MSC323, MSC324, MSC325, MSC326, MSC328, MSC346, MSC347, MSC348, MSC350, MSC356, MSC359, MSC392, MSC402, MSC403, MSC404, MSC405, MSC410, MSC411, MSC436, MSC437, MSC438, MSC439, MSC458, MSC459, MSC460, MSC461, MSC466, MSC467, MSC469, MSC480, MSC494, MSC498, MSC499, MSC500, MSC510, MSC511, MSC522, MSC526, MSC537, MSC551, MSC561, MSC562, MSC563, MSC564, MSC566, MSC567, MSC619, MSC625, MSC627, MSC640, MSC641, MSC643, MSC646, MSC650, MSC656, MSC657, MSC658, MSC659, MSC660, MSC669, MSC670, MSC671, MSC672, MSC673, MSC674, MSC675, MSC676, MSC677, MSC678, MSC679, MSC680, MSC681, MSC682, MSC683, MSC684, MSC687, MSC688, MSC689, MSC690, MSC691, MSC692, MSC693, MSC694, MSC700, MSC701, MSC702, MSC722, MSC723 and MSC724.

The present invention is directed to a method for producing a chondroitin, comprising transferring any of the constructs of the invention to a non-pathogenic bacterial host cell, and culturing the bacterial host cell under fermentation conditions wherein the chondroitin is produced by the bacterial host cell.

The present invention is directed to a method for producing a chondroitin, comprising culturing a non-pathogenic bacterial host cell comprising any of the constructs of the invention under fermentation conditions sufficient for production of the chondroitin.

The present invention is directed to a method for producing a non-pathogenic bacterial host cell comprising transferring any of the constructs of the invention to a non-pathogenic bacterial host cell.

In some embodiments, a gene cluster or gene of any of the constructs of the invention is integrated into a chromosome of the bacterial host cell in any of the methods of the invention.

In some embodiments, two or more copies of a gene cluster or gene of any of the constructs of the invention are integrated into a chromosome of the bacterial host cell in any of the methods of the invention. In some embodiments, the two or more copies of the gene cluster or gene include two or more copies of the same gene or gene cluster.

In some embodiments, the chondroitin produced by any of the methods of the invention is non-fructosylated.

In some embodiments, the methods of the present invention further comprise sulfating the chondroitin.

The present invention is directed to a method for producing a chondroitin sulfate, comprising producing a chondroitin by any of the methods of the invention; and sulfating the chondroitin.

In some embodiments, the process of sulfating the chondroitin in any of the methods of the invention comprises mixing sulfurtrioxide-triethylamine complex or chlorosulfonic acid with the chondroitin in formamide.

In some embodiments, the bacterial host cell in any of the methods of the invention is or is derived from a non-pathogenic organism selected from the group consisting of *Escherichia, Pseudomonas, Xanthomonas, Methylomonas, Acinetobacter,* and *Sphingomonas*.

In some embodiments, the bacterial host cell in any of the methods of the invention is or is derived from a gram-negative organism.

In some embodiments, the bacterial host cell in any of the methods of the invention is a *Xanthomonas campestris*. In some embodiments, the *X. campestris* is a bacterial strain selected from the group consisting of MSC255, MSC256, MSC257, MSC225, and MSC226.

In some embodiments, the bacterial host cell in any of the methods of the invention is a non-pathogenic *E. coli*. In some embodiments, the non-pathogenic *E. coli* is selected from the group consisting of *E. coli* K-12 and *E. coli* B. In some embodiments, the *E. coli* K-12 is a bacterial strain selected from the group consisting of MSC188 and MSC175. In some embodiments, the *E. coli* B is bacterial strain MSC364.

In some embodiments, an endogenous gene of the bacterial host cell in any of the methods of the invention is deleted or inactivated by homologous recombination.

In some embodiments, the bacterial host cell in any of the methods of the invention does not express extracellular polysaccharides endogenous to the host cell.

In some embodiments, the bacterial host cell in any of the methods of the invention is suitable for conjugal transfer from a laboratory cloning strain.

In some embodiments, the methods of the invention further comprise recovering the chondroitin from the bacterial host cell.

In some embodiments, the methods of the invention further comprise recovering the chondroitin from extracellular culture medium.

In some embodiments, 1 g/L to 50 g/L of the chondroitin is secreted from the bacterial host cell in any of the methods of the invention in 24 to 72 hours. In some embodiments, 5 g/L to 50 g/L of the chondroitin is secreted from the bacterial host cell in 24 to 72 hours. In some embodiments, 15 g/L to 50 g/L of the chondroitin is secreted from the bacterial host cell in 24 to 72 hours.

In some embodiments, any of the methods of the invention further comprise purifying the chondroitin.

In some embodiments, the bacterial host cell in any of the methods of the invention is cultured at 25° C. to 37° C.

In some embodiments, the bacterial host cell in any of the methods of the invention is cultured in a medium comprising glycerine.

The present invention is directed to the chondroitin produced by any of the methods of the invention.

The present invention is directed to a composition comprising the chondroitin produced by any of the methods of the invention.

The present invention is directed to an antibody or antibody fragment that binds to an amino acid sequence selected from the group of: SEQ ID NO:92 of KpsF, SEQ ID NO:93 of KpsE, SEQ ID NO:94 of KpsD, SEQ ID NO:95 of KpsU, SEQ ID NO:96 of KpsC, SEQ ID NO:97 of KpsS, SEQ ID NO:91 of KpsT, SEQ ID NO:83 of KfoA, SEQ ID NO:84 of KfoB, SEQ ID NO:85 of KfoC, SEQ ID NO:86 of KfoI (Orf3), SEQ ID NO:87 of KfoE, SEQ ID NO:88 of KfoH (Orf1), SEQ ID NO:89 of KfoF, and SEQ ID NO:90 of KfoG.

BRIEF DESCRIPTION OF THE DRAWINGS

FIG. 3 shows the analysis by the present inventors of the *E. coli* K4 capsule region 2 sequence (AB079602) as described in Ninomiya et al. (*J. Biol. Chem.* 2002; 277:21567-21575).

FIG. 4 relates to the sequences of the region 2 genes of *E. coli* K4 strain ATCC 23502 as determined by the present inventors. FIG. 4A lists differences between the sequences determined by the present inventors as compared to the sequences previously reported by Ninomiya et al. FIG. 4B shows a comparison of the predicted amino acid sequences encoded by the sequences of the region 2 genes, as determined by the present inventors (shown in FIG. 4B as SEQ ID NO:30; SEQ ID NO:32; SEQ ID NO:26; SEQ ID NO:24; and SEQ ID NO:20) with those encoded by the sequences reported by Ninomiya et al. (shown in FIG. 4B as K4 Kfo putORF2 and K4 KfoG_BAC00518; K4 Kfo putORF_1; K4 KfoE_BAC00520; K4 KfoD_BAC00521; K4 KfoB_BAC00524).

FIGS. 10A-10D show the DNA maps of plasmid constructs used to introduce cloned *E. coli* K4 chondroitin biosynthesis genes into *Xanthomonas campestris*.

FIG. 12 shows chondroitinase digestibility of recombinant chondroitin.

FIG. 13 shows chondroitinase digestibility of both K4 fructosylated chondroitin capsular polysaccharide (K4P) and defructosylated K4P (DFK4P).

DETAILED DESCRIPTION OF THE INVENTION

Figure 1A:
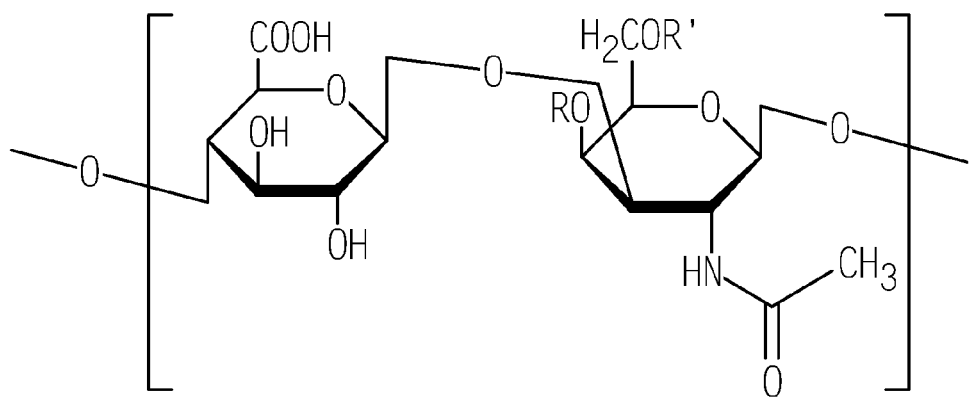
FIG. 1A shows the structure of chondroitin and chondroitin sulfate.
Figure 1B:
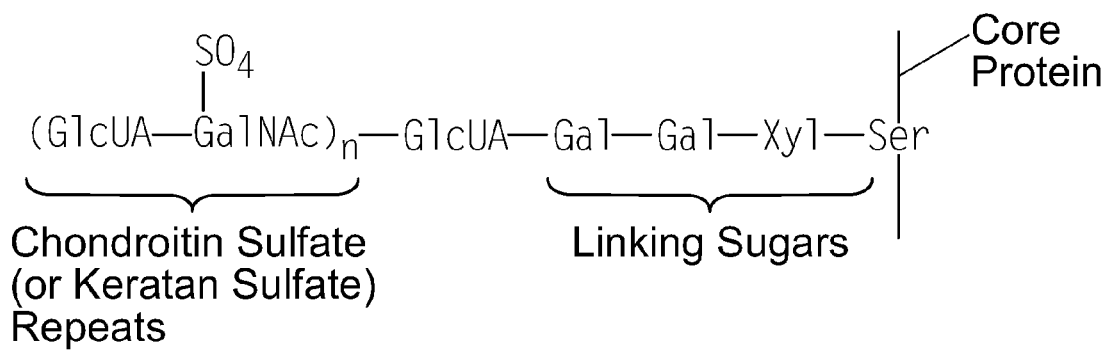
FIG. 1B shows the linkage between chondroitin sulfate and core protein of proteoglycans.

The present invention is directed to constructs and recombinant cells for the production of chondroitin, methods of producing chondroitin, chondroitin produced from the methods, and uses of the chondroitin. As described herein, the present invention is based on a novel technology that allows production of chondroitin and chondroitin sulfate. The present invention meets an important need in the art by providing a safe, consistent, and reliable supply of chondroitin and chondroitin sulfate at lower cost, while providing superior product quality. This process can also provide a vegetarian and kosher product. The recombinantly produced chondroitin can be sulfated using known methods to form chondroitin sulfate. Accordingly, the present invention includes methods of sulfation of the recombinantly produced chondroitin, the recombinantly produced chondroitin sulfate product, as well as uses of the recombinantly produced chondroitin sulfate product.

As described in detail below, the present inventors sequenced the *E. coli* K4 gene cluster encoding proteins involved in biosynthesis of the *E. coli* K4 fructosylated chondroitin capsular polysaccharide (K4P), synthesized and assembled DNA segments based on the native sequence, transferred these genes into alternative host cells that are suitable for large scale fermentation, and demonstrated production of recombinant fructosylated chondroitin capsular polysaccharide in these host cells. Since it is preferable that the alternative host cells should produce non-fructosylated chondroitin, genes responsible for fructosylation of chondroitin by *E. coli* K4 were identified and deleted from the *E. coli* K4 chondroitin biosynthesis gene set transferred to the alternative hosts. As a result, the alternative hosts containing this gene set produced non-fructosylated chondroitin. This recombinant chondroitin (rCH) produced by the alternative host can be sulfated to produce a chondroitin sulfate product.

As used herein, the term "K4P" refers to the native or naturally occurring fructosylated chondroitin capsular polysaccharide as synthesized by the wild type *E. coli* K4 strain. The term "chondroitin" refers to the chondroitin backbone. Chondroitin can be fructosylated or unfructosylated (or non-fructosylated). The term "chondroitin," as used herein, includes both fructosylated and unfructosylated forms, unless specifically noted. Furthermore, as used herein, the term chondroitin refers to unsulfated chondroitin. The chondroitin produced by the methods of present invention can be sulfated by enzymatic or chemical means, as explained in detail below, in which case it is referred to as chondroitin sulfate.

In one aspect, the present invention comprises DNA constructs comprising the *E. coli* K4 gene sets or gene clusters. The term "K4 gene cluster" as used herein refers to the set of genes from *E. coli* K4 that are involved in the biosynthesis of the chondroitin-like capsular polysaccharide (K4P). The term "K4 gene cluster" can refer to all the genes from *E. coli* K4 that are involved in the biosynthesis of the chondroitin-like capsular polysaccharide or to a subset of these genes.

Figure 2:
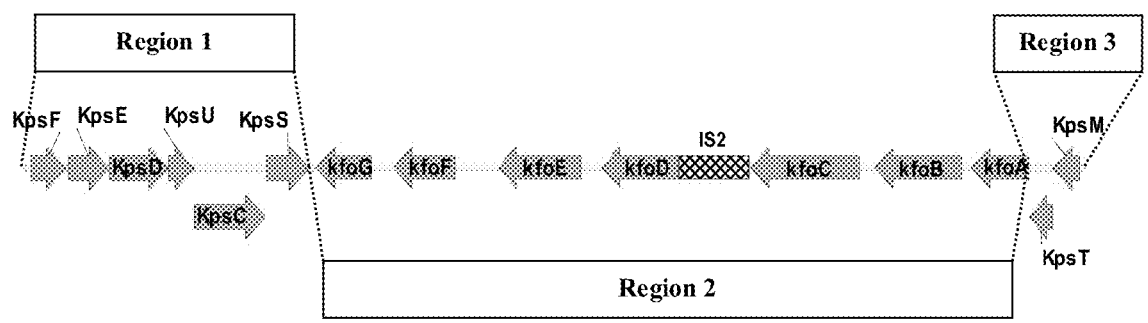
FIG. 2 shows the organization of the gene cluster involved in the synthesis of the *E. coli* K4 capsule, as proposed prior to this invention. The organization of region 2 shown in this figure is as described in Ninomiya et al. (*J. Biol. Chem.* 2002; 277:21567-21575). Regions 1 and 3 of the *E. coli* K4 capsule gene cluster were not sequenced prior to this invention and therefore, their structure was not known prior to this invention.

As described in detail in Example 1, *E. coli* K4 contains a set of multiple genes that are involved in the synthesis of a chondroitin-like capsular polysaccharide referred to as K4P. As noted above, this polysaccharide consists of a chondroitin backbone that is modified by the addition of a fructose residue. As shown in FIG. 2, these genes are organized in three main regions (Region 1 ("R1"), Region 2 ("R2"), and Region 3 ("R3")). Based on the sequence of region 2 described by Ninomiya et al. (2002) (GenBank accession no. AB079602), region 2 was predicted to comprise seven genes relating to capsule biosynthesis, kfoA, kfoB, kfoC, kfoD, kfoE, kfoF and kfoG. Ninomiya et al. did not disclose the sequences of the expected region 1 and region 3 portions of the *E. coli* K4 capsule gene cluster. However, based on the known organization of other *E. coli* capsule gene clusters, region 1 would be predicted to comprise six genes, kpsF, kpsE, kpsD, kpsU, kpsC, kpsS and region 3 would be predicted to comprise two genes, kpsM and kpsT. The kpsM, kpsT, kpsD, kpsE, kpsC and kpsS genes encode proteins required for translocation of the capsular polysaccharide from the cell cytoplasm to the cell surface where the mature capsular polysaccharide is believed to be anchored to the outer cell membrane through a covalent linkage to a lipid component of that membrane (Whitfield, 2006). The kpsF and kpsU genes encode proteins that are predicted to catalyze steps in the biosynthesis of CMP-Kdo. A role of CMP-Kdo in the biosynthesis of chondroitin capsules in *E. coli* has been proposed (Roberts, *Annu. Rev. Microbiol.* 1996; 50:285-315) but has not been demonstrated experimentally (Whitfield, 2006) Thus, prior to the disclosure of the present invention the entire K4 gene cluster was thought to comprise 15 genes.

In order to confirm the sequence reported by Ninomiya et al. (*GenBank accession no. AB*079602), the present inventors sequenced region 2 of the K4 capsule gene cluster from the *E. coli* K4 strain ATCC 23502. When the sequence determined by the present inventors and the AB079602 sequence were compared, single base pair differences were discovered, including substitutions, deletions and insertions at 26 positions. As explained in detail in Example 1, some of these differences result in substantial differences in the predicted amino acid sequences of the region 2 proteins encoded by the gene cluster. Furthermore, the present inventors examined the regions identified by Ninomiya et al. as intergenic sequences separating the genes and identified three additional open reading frames orf1 (also referred to herein as kfoH), orf2 and orf3 (also referred to herein as kfoI) in region 2 that were previously unidentified.

In order to determine the correct sequence of the entire K4 gene cluster comprising genes from all three regions, *E. coli* serotype K4 strain U1-41 was obtained from the Statens Serum Institut (Copenhagen, Denmark). U1-41 is the progenitor of the ATCC 23502 strain and has been reported to produce K4 capsular polysaccharide in culture. It is also the K4 reference strain for *E. coli* serotyping and was used to produce the polysaccharide preparation used for K4P structural determination by Rodriguez et al. (1988). A total of approximately 23 kb of DNA spanning the K4 capsule gene cluster in *E. coli* U1-41 was sequenced. This sequence (SEQ ID NO:117) confirmed the presence of kpsF, kpsE, kpsD, kpsU, kpsC and kpsS genes in region 1 and the presence of kpsM and kpsT genes in region 3. The region 2 sequence of U1-41 and the sequence determined by the present inventors for region 2 of ATCC 23502 were found to be identical.

As described in detail in Example 1, the gene cluster from U1-41 was found to contain (exclusive of IS2 sequences) 17 open reading frames, (instead of 15 as previously described by Ninomiya et al.) that are predicted to encode proteins related to biosynthesis of chondroitin. The arrangement of these genes is typical for an *E. coli* group 2 capsule gene cluster. Region 1, comprising conserved genes kpsF, kpsE, kpsD, kpsU, kpsC and kpsS, and region 3, comprising conserved genes kpsM and kpsT, flank the 9 open reading frames of region 2. Region 1 and region 3 genes include proteins that are required for synthesis and translocation of all group 2 capsules in *E. coli*. Region 1 also includes two genes (kpsF and kpsU) that encode enzymes that are, as noted above, predicted to catalyze steps in the biosynthesis of CMP-Kdo. Of the nine genes identified in region 2, three encode proteins with clearly defined activities relating to capsule biosynthesis: kfoA (UDP-GlcNAc epimerase, which converts UDP-GlcNAc to the UDP-GalNAc precursor), kfoF (UDP-Glc dehydrogenase, which converts UDP-Glc to the UDP-GlcUA precursor) and kfoC (chondroitin synthase, i.e. the polymerase, which can add either one of the precursors, UDP-GalNAc or UDP-GlcUA, to an acceptor chondroitin molecule).

Functions of proteins encoded by other genes present in region 2 of the K4 capsule gene cluster, kfoB, kfoG, kfoD, kfoE, kfoH (orf1) and kfoI (orf3), were not known. The kfoB and kfoG genes encode proteins that are homologous to those encoded by genes present in capsule clusters of bacteria known to produce other glycosaminoglycan (GAG) capsules such as *P. multocida* serotypes A, F and D (Townsend et al., *J. Clin. Microbiol.* 2001; 39:924-929) and *E. coli* serotype K5 (Petit et al., *Mol. Microbiol.* 1995; 4:611-620). This circumstantial evidence suggested that kfoB and kfoG can play a role in biosynthesis of the GAG-containing K4 capsule. As explained in detail in Example 7, the present inventors have found that kfoB and kfoG genes are not essential for the production of chondroitin in *E. coli*, but that kfoG gene is required for the optimal production of chondroitin.

Prior to the present invention, no evidence implicated kfoD, kfoE, kfoH (or orf1) and kfoI (or orf3) as being involved in the biosynthesis of the K4 capsule. Interestingly, the four contiguous K4 genes, kfoD, kfoI (or orf3), kfoE, and kfoH (or orf1), were found to have homologs among the contiguous *P. multocida* serotype B genes bcbDEFG and the *P. multocida* serotype E genes ecbDEFG. However, these two *Pasteurella* strains are not known to be chondroitin producers and the role of these genes in *E. coli* K4 was not known prior to the present invention. Therefore, it appeared that kfoD, kfoI (orf3), kfoE and kfoH (or, might not be involved in the synthesis of chondroitin. As shown in Examples 6 and 7, none of these genes are required for biosynthesis of chondroitin, but one or more of these genes are essential for fructosylation of the chondroitin produced by the K4 gene set.

Using the sequence of the U1-41 K4 capsule gene cluster as the basis, the present inventors further designed synthetic genes that are codon-optimized for expression in hosts such as *E. coli*, *Xanthomonas campestris*, *Sphingomonas elodea* and *Bacillus subtilis*. The design and synthesis of these codon-optimized genes is explained in detail in Example 2. Example 4 describes the construction of plasmid vectors for the expression of these genes in heterologous bacteria.

The complete nucleotide sequences of the codon-optimized genes of the present invention, and the amino acid sequences encoded by them, are as follows. The complete nucleotide sequence for kpsF used in the present invention is represented herein as SEQ ID NO:1. kpsF is a 981 nucleotide sequence (not including the stop codon) which encodes a 327 amino acid sequence, represented herein as SEQ ID NO:2. The complete nucleotide sequence for kpsE is represented herein as SEQ ID NO:3. kpsE is a 1146 nucleotide sequence (not including the stop codon) which encodes a 382 amino acid sequence, represented herein as SEQ ID NO:4. The complete nucleotide sequence for kpsD is represented herein as SEQ ID NO:5. kpsD is a 1674 nucleotide sequence (not including the stop codon) which encodes a 558 amino acid sequence, represented herein as SEQ ID NO: 6. The complete nucleotide sequence for kpsU is represented herein as SEQ ID NO:7. kpsU is a 738 nucleotide sequence (not including the stop codon) which encodes a 246 amino acid sequence, represented herein as SEQ ID NO:8. The complete nucleotide sequence for kpsC is represented herein as SEQ ID NO:9. kpsC is a 2025 nucleotide sequence (not including the stop codon) which encodes a 675 amino acid sequence, represented herein as SEQ ID NO:10. The complete nucleotide sequence for kpsS is represented herein as SEQ ID NO:11. kpsS is a 1209 nucleotide sequence (not including the stop codon) which encodes a 403 amino acid sequence, represented herein as SEQ ID NO:12. The complete nucleotide sequence for kpsM is represented herein as SEQ ID NO:13. kpsM is a 774 nucleotide sequence (not including the stop codon) which encodes a 258 amino acid sequence, represented herein as SEQ ID NO:14. The complete nucleotide sequence for kpsT is represented herein as SEQ ID NO:15. kpsT is a 666 nucleotide sequence (not including the stop codon) which encodes a 222 amino acid sequence, represented herein as SEQ ID NO:16. The complete nucleotide sequence for kfoA is represented herein as SEQ ID NO:17. kfoA is a 1017 nucleotide sequence (not including the stop codon) which encodes a 339 amino acid sequence, represented herein as SEQ ID NO:18. The complete nucleotide sequence for kfoB is represented herein as SEQ ID NO:19. kfoB is a 1638 nucleotide sequence (not including the stop codon) which encodes a 546 amino acid sequence, represented herein as SEQ ID NO:20. The complete nucleotide sequence for kfoC is represented herein as SEQ ID NO:21. kfoC is a 2058 nucleotide sequence (not including the stop codon) which encodes a 686 amino acid sequence, represented herein as SEQ ID NO:22. The complete nucleotide sequence for kfoD is represented herein as SEQ ID NO:23. kfoD is a 1431 nucleotide sequence (not including the stop codon) which encodes a 477 amino acid sequence, represented herein as SEQ ID NO:24. The complete nucleotide sequence for kfoE is represented herein as SEQ ID NO:25. kfoE is a 1566 nucleotide sequence (not including the stop codon) which encodes a 522 amino acid sequence, represented herein as SEQ ID NO:26. The complete nucleotide sequence for kfoF is represented herein as SEQ ID NO:27. kfoF is a 1167 nucleotide sequence (not including the stop codon) which encodes a 389 amino acid sequence, represented herein as SEQ ID NO:28. The complete nucleotide sequence for kfoG is represented herein as SEQ ID NO:29. kfoG is a 1464 nucleotide sequence (not including the stop codon) which encodes a 488 amino acid sequence, represented herein as SEQ ID NO:30.

The complete nucleotide sequence for orf1 (also referred to herein as kfoH) is represented herein as SEQ ID NO:31. orf1 is a 723 nucleotide sequence (not including the stop codon) which encodes a 241 amino acid sequence, represented herein as SEQ ID NO:32. The complete nucleotide sequence for orf3 (also referred to herein as kfoI) is represented herein as SEQ ID NO:33. orf3 is a 378 nucleotide sequence (not including the stop codon) which encodes a 126 amino acid sequence, represented herein as SEQ ID NO:34.

In various embodiments, the present invention comprises DNA constructs comprising the *E. coli* K4 gene cluster, one or more regions of the *E. coli* K4 gene cluster, one or more subsets of genes from the *E. coli* K4 gene cluster, one or more individual genes from the *E. coli* K4 gene cluster, or combinations thereof, wherein the constructs are useful for the purpose of producing chondroitin or increasing the amount of chondroitin in a bacterial host cell. In various embodiments, the constructs can include the entire 17 gene cluster described above or one or more genes of the 17 gene cluster described above, i.e. kpsF, kpsE, kpsD, kpsU, kpsC, kpsS, kpsM, kpsT, kfoA, kfoB, kfoC, kfoD, kfoE, kfoF, kfoG, kfoH and kfoI. In some embodiments, the construct comprises one or more regions of the K4 cluster (i.e., regions 1, 2, and/or 3 as described herein). In some embodiments, the construct comprises one or more subsets of genes from the K4 cluster (including subsets of genes from regions 1, 2, and/or 3 as described herein). The construct can comprise a gene cluster in which a gene in the cluster is present in any order relative to any other gene in the cluster. As such, the ordering of genes in a gene cluster within the construct can be different from the naturally occurring order of genes within the K4 cluster. Similarly, the construct can comprise a region, a subset of genes, or a gene from the K4 cluster that can be in any order within the construct relative to any other region, subset of genes, or individual genes from the K4 cluster. In some embodiments, the genes are present in a specified order in the construct. The constructs can include one or more native genes (i.e., the genes having the sequence present in *E. coli* K4 U1-41 or other serotype K4 strains) that were isolated from the *E. coli* serotype K4 strain U1-41 mentioned above and/or one or more synthetic genes, i.e., the genes based on the native genes isolated from U1-41 but in which the DNA sequences have been modified for optimal codon usage in the bacterial host cell, without altering the amino acid sequences encoded by those genes. The design and preparation of such synthetic genes is explained in Example 2.

As noted above and further explained in detail in Examples 6 and 7, one or more of the kfoD, kfoI, kfoE and kfoH genes are essential for fructosylation of chondroitin in *E. coli*, but none of these genes is required for synthesis of chondroitin. Simultaneous omission or inactivation of all four of these genes results in the production of unfructosylated chondroitin. In some embodiments, a construct of the invention does not contain a functional gene of one or more of kfoD, kfoI, kfoE and kfoH. In other words, a functional gene of one or more of kfoD, kfoI, kfoE and kfoH is absent from the construct in these embodiments. A construct that does not contain a functional gene (i.e., a construct in which a functional gene is absent) includes constructs in which the entire gene is absent as well as constructs in which the gene or portion thereof is present but is non-functional (i.e., inactive). In some embodiments, a construct of the invention comprises a gene cluster that has been modified to inactivate one or more of kfoD, kfoI, kfoE and kfoH.

In some embodiments, the present invention includes a construct that comprises a gene cluster comprising kpsF, kpsE, kpsD, kpsU, kpsC, kpsS, kfoA, kfoC, and kfoF, wherein the construct does not contain a functional gene of one or more of kfoD, kfoI, kfoE and kfoH. In some embodiments, the construct is suitable for producing a chondroitin in a non-pathogenic bacterial host cell as described herein. In some embodiments, the chondroitin is non-fructosylated. In some embodiments, the construct can further comprise kfoG and/or kfoB. As noted above, kfoB and kfoG genes were not found to be essential for the production of chondroitin, but the kfoG gene was found to be required for the optimal production of chondroitin (See example 7). In some embodiments, the construct of the present invention can further comprise kpsM and/or kpsT.

In some embodiments, the constructs are useful for the production of recombinant chondroitin that is secreted from the cell.

In some embodiments, these constructs include the expression vectors pDD66 (expression vector containing kpsMT-kfoABCFG-kpsFEDUCS), pDD67 (expression vector containing kpsFEDUCS-kpsMT-kfoABCFG), pCX040 (expression vector containing kpsMT-kfoACFG-kpsFEDUCS), pCX041 (expression vector containing kpsMT-kfoABCF-kpsFEDUCS), pCX042 (expression vector containing kpsFEDUCS-kpsMT-kfoACFG), pCX043 (expression vector containing kpsFEDUCS-kpsMT-kfoABCF), and pCX096 (expression vector containing kpsFEDUCS-kfoABCFG). Another embodiment is expression plasmid pBR1052. As described in Example 4, pBR1052 contains the same K4 gene set as pDD66 (kpsMT-kfoABCFG-kpsFEDUCS) and additionally has a second copy of the Pm promoter sequence inserted immediately upstream of the kpsF gene. The nucleotide sequence of pDD66 is denoted by SEQ ID NO:35; the nucleotide sequence of pDD67 is denoted by SEQ ID NO:36; the nucleotide sequence of pCX040 is denoted by SEQ ID NO:37; the nucleotide sequence of pCX041 is denoted by SEQ ID NO:38; the nucleotide sequence of pCX042 is denoted by SEQ ID NO:39; the nucleotide sequence of pCX043 is denoted by SEQ ID NO:40; the nucleotide sequence of pCX096 is denoted by SEQ ID NO:149; and the nucleotide sequence of pBR1052 is denoted by SEQ ID NO:41. The design and construction of these DNA constructs is explained in detail in Example 4.

In some embodiments, the present invention includes constructs that are useful for the purpose of producing intracellular chondroitin, i.e., chondroitin that is not secreted from the host cell. Intracellular production of chondroitin can be desirable in order to eliminate viscosity of the fermentation resulting from high levels of polysaccharide in the culture medium. In addition, it is possible that intracellular production could achieve higher levels of chondroitin than secretion. In some embodiments, the construct does not contain a functional gene of at least one of kpsM and kpsT of region 3. In some embodiments, the construct comprises a gene cluster that does not contain or has been modified to inactivate at least one of kpsM and kpsT of region 3. In some embodiments, the construct does not contain a functional gene of at least one of kpsE, kpsD, kpsC and kpsS of region 1. In some embodiments, the construct comprises a gene cluster that does not contain or has been modified to inactivate at least one of kpsE, kpsD, kpsC and kpsS of region 1. In some embodiments, the construct does not contain a functional gene of at least one of kpsM and kpsT of region 3 and at least one of kpsE, kpsD, kpsC and kpsS of region 1. In some embodiments, the construct comprises a gene cluster that does not contain or has been modified to inactivate at least one of kpsM and kpsT of region 3 and at least one of kpsE, kpsD, kpsC and kpsS of region 1. These constructs are described in Examples 4 and 9.

In some embodiments, the present invention includes a construct comprising a gene cluster comprising kfoA, kfoC, and kfoF, wherein the gene cluster does not contain a functional gene of one or more of kpsM, kpsT, kpsE, kpsD, kpsC and kpsS. In some embodiments, the construct is suitable for producing a chondroitin in a non-pathogenic bacterial host cell as described herein. In some embodiments, the chondroitin is not secreted from the host cell. In some embodiments, the chondroitin is non-fructosylated. In some embodiments, the construct also does not contain a functional gene of one or more of kfoD, orf3, kfoE, and orf1. In some embodiments, the construct can further comprise kfoG and/or kfoB. In some embodiments, the construct comprises kfoA, kfoB, kfoC, kfoF and kfoG.

In some embodiments, a construct of the present invention includes a gene selected from the group consisting of kfoA, kfoB, kfoC, kfoF, kfoG, and a combination thereof, wherein the construct does not contain a functional gene of one or more of kpsM, kpsT, kpsE, kpsD, kpsC and kpsS. In some embodiments, the construct is suitable for producing a chondroitin in a non-pathogenic bacterial host cell as described herein. In some embodiments, the construct is suitable for increasing the amount of a chondroitin in a non-pathogenic bacterial host cell as described herein. In some embodiments, the construct is transferred to a bacterial host cell comprising one or more existing copies of the E. coli K4 gene cluster, regions of the cluster, subsets of genes of the cluster, or genes of the cluster that have been integrated into the host chromosome. In some embodiments, the chondroitin is non-fructosylated. In some embodiments, the construct also does not contain a functional gene of one or more of kfoD, orf3, kfoE, and orf1. In some embodiments, the construct comprises kfoA, kfoB, kfoC, kfoF and kfoG.

In some embodiments, a construct of the present invention comprises the expression vectors pCX039 (expression vector containing kfoABCFG), pCX044 (expression vector containing kfoACFG), pCX092 (expression vector containing kfoABCF), pCX045 (expression vector containing kpsMT-kfoABCFG-kpsFEDUS), and pCX048 (expression vector containing kpsM-kfoABCFG-kpsFEDUCS). The nucleotide sequence of pCX039 is denoted by SEQ ID NO:42; the nucleotide sequence of pCX044 is denoted by SEQ ID NO:43; the nucleotide sequence of pCX092 is denoted by SEQ ID NO:154; the nucleotide sequence of pCX045 is denoted by SEQ ID NO:44; and the nucleotide sequence of pCX048 is denoted by SEQ ID NO:45. The design and construction of these DNA constructs is explained in detail in Example 4.

In some embodiments, a construct of the present invention comprises the expression vectors pCX075 (expression vector containing kfoABFG), pCX081 (expression vector containing kfoABCG), pCX082 (expression vector containing kfoBCFG), pCX101 (expression vector containing kfoABCFG-kpsMT), pBR1102 (expression vector containing kfoABCFG), pBR1100 (expression vector containing kfoABCFG), and pBR1101 (expression vector containing kfoABCFG). The nucleotide sequence of pCX075 is denoted by SEQ ID NO:153; the nucleotide sequence of pCX081 is denoted by SEQ ID NO:151; the nucleotide sequence of pCX082 is denoted by SEQ ID NO:152; the nucleotide sequence of pCX101 is denoted by SEQ ID NO:150; the nucleotide sequence of pBR1102 is denoted by SEQ ID NO:170; the nucleotide sequence of pBR1100 is denoted by SEQ ID NO:171; and the nucleotide sequence of pBR1101 is denoted by SEQ ID NO:172. The design and construction of these DNA constructs is explained in detail in Examples 18 and 20.

The constructs of the present invention can comprise one or more genes that are modified for optimal codon usage in a bacterial host cell as described herein.

The constructs of the present invention can further comprise a promoter. The promoter should be capable of driving expression of the gene cluster in a bacterial host cell as described herein. Numerous such promoters, which are useful to drive expression in the desired bacterial host cell are familiar to those skilled in the art and can be used in the present invention. Examples of promoters that have been commonly used to express heterologous proteins include, without limitation, Pm, lac, trp, tac, λpL, T7, phoA, araC, xapA, cad and recA (See, e.g., Weikert et al., *Curr. Opin. Biotechnol.* 1996; 7:494-499). Such promoters can be constitutive or inducible. Termination control regions can also be derived from various genes native to the preferred hosts. Optionally, a termination site may be unnecessary.

In some embodiments, the constructs of the present invention comprise the Pm promoter along with the xylS regulatory gene (Mermod et al., *J. Bacteriol.* 1986; 167:447-54). The Pm promoter, which is isolated from *Pseudomonas putida* TOL plasmid and its regulatory gene xylS provide a strong, well regulated promoter shown to function in a variety of gram negative bacteria (Blatny et al., *Plasmid* 1997; 38:35-51). The XylS protein can exist as a monomer or dimer. In the dimeric form, the XylS protein can bind to the Pm promoter and stimulate transcription. Dimerization of the XylS protein, and thus transcriptional initiation at the Pm promoter, is enhanced by certain effector molecules such as meta-toluic acid (3-methylbenzoate) which bind directly to XylS and promote dimerization of the protein. (Dominguez-Cuevas et al., *J. Bact.* 2008; 190:3118-3128). The promoter can be operably linked to one or more genes of the gene cluster.

The constructs of the present invention can further comprise a second promoter. For example, if analysis of expression of cloned K4 genes in an alternative host indicated that the level of expression of a certain gene, or gene set, is less than optimal, a second promoter can be added to the expression construct at a location that is selected so as to enhance the transcription of the gene or gene set that is not expressed at an optimal level. Typically, the added promoter would be inserted immediately upstream (i.e., 5' to) the gene or gene set of interest. The second promoter can be Pm, or any of the promoters listed above as examples of promoters useful expressing K4 gene sets. In some embodiments, the second promoter can be Pm. The second promoter can be operably linked to one or more genes of the gene cluster. In one embodiment, the second promoter can be operably linked to kpsFEDUCS gene set. See, for instance, expression vector pBR1052 as described in Example 4. The genes, or combinations of genes, that it would be advantageous to express, or augment the expression of, by use of a second promoter can be determined empirically for any given plasmid, or chromosomal, gene set by western blot analysis.

The constructs of the present invention can further comprise an antibiotic resistance gene that confers resistance to a particular antibiotic. Such genes are well known in the art. Examples of antibiotic resistance genes include, without limitation, chloramphenicol resistance gene (CamR), kanamycin resistance gene (KanR), ampicillin resistance gene (AmpR), tetracycline resistance gene (TetR), spectinomycin resistance gene (SpcR), sulfonamide resistance gene (SuR), bleomycin resistance gene (BleR), streptomycin resistance gene (StrR), carbenicillin resistance gene (CbR) and erythromycin resistance gene (EryR).

The constructs of the present invention are useful for producing chondroitin in a bacterial host cell. While any bacterial cell can be used as a host cell in the present invention, in some embodiments the host is a gram-negative bacterium. Examples of gram negative bacteria include, without limitation, *Escherichia, Pseudomonas, Xanthomonas, Methylomonas, Acinetobacter* and *Sphingomonas*. In some embodiments the host is a non-pathogenic gram-negative bacterium. Examples of non-pathogenic gram-negative bacteria include without limitation, non-pathogenic *E. coli* such as *E. coli* K-12 or *E. coli* B, *Xanthomonas campestris, Sphingomonas elodea* and *Pseudomonas putida*.

In some embodiments, an endogenous gene of a bacterial host cell as described herein is deleted or inactivated by homologous recombination.

Derivatives of hosts that are unable to manufacture their native extracellular polysaccharides are desirable. Use of such derivative hosts would facilitate the visual and chemical identification of biosynthesis of recombinant chondroitin (rCH), as well as the purification of the rCH produced by the host when a K4 gene set is introduced. Furthermore, biosynthesis of rCH in appropriately designed derivative hosts would not be limited by competition with the native polysaccharide synthesis. For example, inactivation or deletion of the first glycosyltransferase genes of a native polysaccharide biosynthetic pathway would prevent utilization of any potential lipid carrier by the native pathway and prevent competition between the enzymes of the native pathway and the K4 enzymes for the lipid carrier, or any other cellular component(s) that acts on nascent polysaccharide chains and might be limiting in availability. Inactivation (e.g. by deletion) of the entire native biosynthetic gene clusters would remove most of the competitive elements, but could potentially have undesirable effects on physiology and/or membrane structure.

As described in detail in Example 3, the present inventors have, by way of example and without intending to be limited to these examples, used *E. coli* K-12 ("K-12"), *E. coli* B ("EcB"), and *Xanthomonas campestris* pv. *campestris* ("Xcc") as hosts for the expression of the constructs of the present invention. Generation of derivative hosts that comprise deletions in one or more genes of the gene cluster that encode enzymes for synthesis of native extracellular polysaccharides was carried out using a two-step, "pop-in/pop-out" homology-driven method as described in detail in Example 3. For example, colanic acid (M antigen) is an extracellular polysaccharide produced by many enteric bacteria. *E. coli* K-12 and *E. coli* B strains that are deficient or defective in the colanic acid biosynthesis were created. Strains MSC188 and MSC175 are derivatives of *E. coli* K-12 strain that comprise a deletion of the entire colanic acid operon, and the wcaJ gene encoding the glycosyltransferase enzyme responsible for loading of the first sugar onto a lipid carrier during colanic acid biosynthesis, respectively. Strain MSC364 is a derivative of *E. coli* B that comprises a deletion of the entire colanic acid operon. Similarly, *Xanthomonas campestris* pv. *campestris* strains that are deficient or defective in the biosynthesis of the extracellular polysaccharide xanthan gum were created. Strains MSC225 and MSC226 are derivatives of Xcc strain that comprise a deletion of the gumD gene encoding the glycosyltransferase I enzyme and strains MSC255, MSC256, and MSC257 comprise a deletion of the entire xanthan gum operon.

The present invention is directed to a method for producing a non-pathogenic bacterial host cell comprising any one or more of the constructs of the present invention, comprising transferring any one or more of the constructs of the present invention to a non-pathogenic bacterial host cell. The constructs of the present invention can be introduced into bacterial host cells by any known method for expression of the genes present within the constructs. Such methods can include, without limitation, transformation, electroporation, conjugation or transduction.

The present invention is directed to a non-pathogenic bacterial host cell comprising any one or more of the constructs of the present invention. As such, the present invention also includes various strains that were created by introducing the constructs comprising expression vectors of the present invention into the host strains, including the derivative strains comprising deletions. Certain examples are described in detail in Examples 6-9, 11, 13 and 14.

In some embodiments, the genes contained within the constructs of the invention are introduced into the chromosome of the recipient host strain such that the genes are integrated within the host chromosome. Placing the cloned genes in the chromosome provides the advantage of eliminating the requirement for maintaining selective pressure to maintain the plasmid(s) or vector(s) which carry the chondroitin biosynthesis genes and can thus potentially provide more stable expression strains or expression strains that are stable in the absence of any selective pressure. Accordingly, the present invention includes bacterial strains that comprise one or more copies of any one or more of the genes contained within the constructs of the present invention integrated into their chromosome.

By way of example, the present inventors have created E. coli K-12 and Xcc strains that include one or more of the synthetic genes for the biosynthesis of chondroitin integrated into their chromosomes. The present invention also includes strains that were created by introducing the constructs comprising expression vectors of the present invention into the strains of the present invention that comprise one or more copies of the constructs integrated into their chromosome.

In some embodiments, the K4 gene cluster, one or more regions of the cluster, one or more subsets of genes of the cluster, or one or more genes of the cluster are integrated into the chromosome of a non-pathogenic bacterial host cell as described herein using a construct of the invention and methods described herein. In some embodiments, two or more copies of the gene cluster, region, subset, or gene are integrated into the chromosome of a non-pathogenic bacterial host cell. In some embodiments, 2 to 20; 2 to 19; 2 to 18; 2 to 17; 2 to 16; 2 to 15; 2 to 14; 2 to 13; 2 to 12; 2 to 11; 2 to 10; 2 to 9; 2 to 8; 2 to 7; 2 to 6; 2 to 5; 2 to 4; or 2 to 3 copies of the gene cluster, region, subset, or gene are integrated into the chromosome of a non-pathogenic bacterial host cell. In some embodiments, 2, 3, 4, 5, 6, 7, 8, 9, 10, 11, 12, 13, 14, 15, 16, 17, 18, 19 or 20 copies of the gene cluster, region, subset, or gene are integrated into the chromosome of a non-pathogenic bacterial host cell. In some embodiments, the two or more copies are integrated into the host chromosome using the same construct. In some embodiments, the two or more copies are integrated into the host chromosome using different constructs. In some embodiments, a promoter is also integrated into the host chromosome to control expression of the gene cluster, region, subset, or gene that is integrated into the host chromosome. In some embodiments, the two or more copies that are integrated into the host chromosome are expressed from the same promoter or from different promoters. In some embodiments, two or more copies of a region 2 gene selected from the group consisting of kfoA, kfoB, kfoC, kfoF, kfoG, and a combination thereof are integrated into a host chromosome. In some embodiments, two or more copies of kfoA, kfoB, kfoC, kfoF, and kfoG are integrated into a host chromosome. In some embodiments, two or more copies of region 1, region 3, or one or more genes from region 1 or region 3 are integrated into a host chromosome. In some embodiments, genes contained within a construct of the invention are integrated into the chromosome of a bacterial host cell that also contains one or more constructs of the invention comprising genes that are not integrated into the chromosome.

Examples of such strains are described in detail in Examples 10-13 and 20-21. The constructs and strains described can be used for production of chondroitin.

Examples of the strains of the present invention include, without limitation, E. coli K-12 strains MSC279, MSC280, MSC322, MSC323, MSC324, MSC325, MSC328, MSC346, MSC356, MSC359, MSC392, MSC402, MSC403, MSC404, MSC405, MSC410, MSC411, MSC436, MSC437, MSC438, MSC439, MSC458, MSC459, MSC460, MSC466, MSC467, MSC498, MSC499, MSC500, MSC510, MSC511, MSC522, MSC526, MSC537, MSC551, MSC561, MSC562, MSC563, MSC564, MSC566, MSC567, MSC619, MSC625, MSC627, MSC640, MSC641, MSC643, MSC646, MSC650, MSC656, MSC657, MSC658, MSC659, MSC660, MSC669, MSC670, MSC671, MSC672, MSC673, MSC674, MSC675, MSC676, MSC677, MSC678, MSC679, MSC680, MSC681, MSC682, MSC683, MSC684, MSC687, MSC688, MSC689, MSC690, MSC691, MSC692, MSC693, MSC694, MSC700, MSC701, MSC702, MSC722, MSC723, and MSC724; E. coli B strains MSC315, MSC316, MSC317, MSC319, and MSC347; and X. campestris strains MSC326, MSC348, MSC350, MSC480, MSC461, MSC469 and MSC494.

The present invention is directed to a method for producing a chondroitin, comprising transferring any one or more of the constructs of the present invention to a non-pathogenic bacterial host cell, and culturing the bacterial host cell under fermentation conditions wherein the chondroitin is produced by the bacterial host cell.

The present invention is directed to a method for producing a chondroitin, comprising culturing a non-pathogenic host cell comprising any one or more of the constructs of the present invention under fermentation conditions sufficient for production of chondroitin.

The present invention includes a method for producing an unsulfated chondroitin. The method comprises culturing a non-pathogenic bacterial host cell of the invention under fermentation conditions sufficient for production of unsulfated chondroitin. In some embodiments, the method comprises transferring the constructs of the present invention to a non-pathogenic bacterial host cell and culturing the bacterial host cell under fermentation conditions, which results in the production of unsulfated chondroitin by the bacterial host cell.

Various embodiments are described in examples 7-15. Specifically, Examples 6-9, 11, 13 and 14 present data demonstrating production of chondroitin when the constructs of the present invention are transformed into host cells and Examples 10-15 present data demonstrating production of chondroitin when the constructs of the present invention are integrated into the chromosome of the host cell.

Depending on the specific construct and the combination of genes therein, it is possible to produce chondroitin that is fructosylated or non-fructosylated (see Examples 6 and 7).

Furthermore, depending on the specific construct and the combination of genes therein, the recombinant chondroitin can be secreted into the culture medium or retained in an intracellular location (See Example 9).

Methods of culturing bacterial cells and compositions of culture media are well known in the art and can be used in the present invention. For optimal production of recombinant chondroitin, various culture parameters such as temperature, pH, dissolved oxygen concentration, inducer concentration and duration of culture post-induction, as well as composition of the media including content of nutrients and salts therein should be optimized Example 8 describes the recombinant production of chondroitin in a variety of growth media, temperatures and induction conditions. Based on this information, further optimization of such parameters will be readily apparent to one skilled in the art. In some embodiments, the bacterial host cell is cultured at 20° C. to 37° C., e.g., 20° C., 21° C., 22° C., 23° C., 24° C., 25° C., 26° C., 27° C., 28° C., 29° C., 30° C., 31° C., 32° C., 33° C., 34° C., 35° C., 36° C. or 37° C. In some embodiments, the culture medium comprises yeast extract, a protein digest, a potassium phosphate, and water. In some embodiments, the culture medium comprises glycerine (also known as glycerol). In some embodiments, 1 g/L to 50 g/L, 5 g/L to 50 g/L or 15 g/L to 50 g/L of the unsulfated chondroitin is secreted from the bacterial host cell in 24 to 72 hours.

In some embodiments, a method for producing a chondroitin of the invention further comprises recovering the chondroitin from the bacterial host cell.

In some embodiments, a method for producing a chondroitin of the invention further comprises recovering the chondroitin from extracellular culture medium. Chondroitin can be recovered from fermentation broth by alcohol precipitation or any technique known in the art, including without limitation, lyophilization to obtain dry powder.

In some embodiments, a method for producing a chondroitin can include the step of purifying the recovered chondroitin. Purification of chondroitin can be accomplished by any technique known in the art, including, for example, alkali treatment, acid treatment, proteinases treatment, chromatography, extraction, solvent extraction, membrane separation, electrodialysis, reverse osmosis, distillation, precipitation, chemical derivatization, crystallization, ultrafiltration, and/or precipitation of the polysaccharide using organic solvents. See, for example, Taniguchi, N., 1982. Isolation and analysis of glycosaminoglycans. Pages 20-40 in: Glycosaminoglycans and Proteoglycans in Physiological and Pathological Process of Body Systems. R. S. Varma and R. Varma, ed. Karger, Basel, Switzerland; Fraquharson et al., *Oral. Microbiol. Immunol.* 2000; 15:151-157; Manzoni et al., *J. Bioact. Comp. Polm.* 1993; 8:251-257; Manzoni et al., *Biotechnol. Letters* 2000; 22:759-766; Johns et al., *Aust. J. Biotechnol.* 1991; 5:73-77; each of these documents is incorporated by reference herein in its entirety. Examples of precipitation solvents can include, without limitation, acetone, methanol, ethanol, or isopropanol.

In some embodiments, the method for producing a chondroitin further comprises sulfating the chondroitin.

The present invention is directed to a method for producing a chondroitin sulfate, comprising producing a chondroitin by a method of the present invention and sulfating the chondroitin.

Sulfation can be done chemically or enzymatically. Several procedures are known in the art for chemical sulfation of polysaccharides, any one of which can be used here. For example, sulfation can be accomplished by solubilization of the polysaccharide into an organic solvent followed by reacting with a sulfating agent under a controlled temperature. Examples of solubilization solvents can include, without limitation, formamide, N,N-dimethylformamide (DMF), pyridine, or dimethylsulfoxide. Examples of sulfating agents can include, without limitation, chlorosulfonic acid, sulfur trioxide, and various sulfur trioxide-amine complexes. Examples of amines suitable for the sulfur trioxide-amine complexes include, without limitation, pyridine, DMF, trimethylamine, triethylamine (TEA) and piperidine. In some embodiments, upon sulfation of recombinant chondroitin, the sulfated product contains 5.0 to 7.5% of sulfur content which corresponds to that of natural chondroitin sulfate. In further embodiments, the sulfated product does not undergo significant depolymerization. Example 15 describes a method for chemical sulfation of recombinant chondroitin. In some embodiments, sulfating a chondroitin produced by a method of the invention comprises mixing sulfurtrioxide-triethylamine complex or chlorosulfonic acid with the chondroitin in formamide.

The present invention is directed to a recombinant chondroitin or a recombinant chondroitin sulfate produced by any of the methods described herein.

The present invention is directed to a composition comprising a recombinant chondroitin or a recombinant chondroitin sulfate produced by any of the methods described herein.

In some embodiments, the composition can include a supplement such as glucosamine, glucosamine sulfate or glucosamine hydrochloride. Glucosamine (2-acetamido-2-deoxyglucose) is a naturally occurring compound that is found in cartilage. Glucosamine sulfate is a normal constituent of glycosaminoglycans in the cartilage matrix and synovial fluid. Some clinical trials support the use of glucosamine sulfate in the treatment of osteoarthritis, particularly that of the knee (Herrero-Beaumont et al., *Arthritis Rheum.* 2007; 56:555-67; Bruyere et al., *Osteoarthritis Cartilage* 2008; 16:254-60). It has been proposed that the sulfate moiety provides clinical benefit in the synovial fluid by strengthening cartilage and aiding glycosaminoglycan synthesis (Silbert *Glycobiology* 2009; 19:564-567). Glucosamine is commonly provided in combination with chondroitin sulfate in nutritional supplements intended to promote joint health and as a treatment for osteoarthritis.

In some embodiments, the present invention includes methods of maintaining healthy joint function in a subject. In other embodiments, the present invention includes methods for treating or preventing osteoarthritis, interstitial cystitis and/or synovitis. These methods comprise administering to the subject the compositions comprising the recombinant chondroitin sulfate described above. The compositions of the present invention can be generally administered in therapeutically effective amounts.

The present invention is directed to an antibody or antibody fragment that selectively binds to a protein encoded by a gene of the K4 chondroitin biosynthetic gene cluster. These antibodies and antibody fragments can be used to confirm the expression of genes of the K4 chondroitin biosynthetic gene cluster in the bacterial hosts. In some embodiments, the antibody or antibody fragment binds to an amino acid sequence selected from the group consisting of SEQ ID NO:92 of KpsF, SEQ ID NO:93 of KpsE, SEQ ID NO:94 of KpsD, SEQ ID NO:95 of KpsU, SEQ ID NO:96 of KpsC, SEQ ID NO:97 of KpsS, SEQ ID NO:91 of KpsT, SEQ ID NO:83 of KfoA, SEQ ID NO:84 of KfoB, SEQ ID NO:85 of KfoC, SEQ ID NO:86 of KfoI (Orf3), SEQ ID NO:87 of KfoE, SEQ ID NO:88 of KfoH (Orf1), SEQ ID NO:89 of KfoF, and SEQ ID NO:90 of KfoG. The generation of the antibodies is described in detail in Example 5.

Fermentation Media and Conditions

In the method for production of chondroitin, a microorganism having a genetic modification described herein is cultured in a fermentation medium to produce chondroitin. An appropriate, or effective, fermentation medium refers to any medium in which a genetically modified microorganism of the present invention, when cultured, is capable of producing chondroitin. Such a medium is typically an aqueous medium comprising assimilable carbon, nitrogen and phosphate sources. Such a medium can also include appropriate salts, minerals, metals and other nutrients. Exemplary media are described below and in the Examples section. It should be recognized, however, that a variety of fermentation conditions are suitable and can be selected by those skilled in the art.

Sources of assimilable carbon which can be used in a suitable fermentation medium include, but are not limited to, sugars and their polymers, including dextrin, sucrose, maltose, lactose, glucose, fructose, mannose, sorbose, arabinose and xylose; fatty acids; organic acids such as acetate; primary alcohols such as ethanol and n-propanol; and polyalcohols such as glycerine. Carbon sources in the present invention include polyalcohols, monosaccharides, disaccharides, and trisaccharides. In some embodiments, the carbon source is glycerine.

The concentration of a carbon source, such as glycerine, in the fermentation medium should promote cell growth, but not be so high as to repress growth of the microorganism used. Typically, fermentations are run with a carbon source, such as glycerine, being added at levels to achieve the desired level of growth and biomass, but maintained at low concentration levels (below 1 g/L) to avoid accumulation of organic acids, specifically acetate. In other embodiments, the concentration of a carbon source, such as glycerine, in the fermentation medium is greater than 1 g/L, greater than 2 g/L, or greater than 5 g/L. In addition, the concentration of a carbon source, such as glycerine, in the fermentation medium is typically less than 100 g/L, less than 50 g/L, or less than 20 g/L. It should be noted that references to fermentation component concentrations can refer to both initial and/or ongoing component concentrations. In some cases, it can be desirable to allow the fermentation medium to become depleted of a carbon source during fermentation.

Sources of assimilable nitrogen which can be used in a suitable fermentation medium include, but are not limited to, simple nitrogen sources, organic nitrogen sources and complex nitrogen sources. Such nitrogen sources include anhydrous ammonia, ammonium salts and substances of animal, vegetable and/or microbial origin. Suitable nitrogen sources include, but are not limited to, protein hydrolysates, microbial biomass hydrolysates, peptone, yeast extract, ammonium sulfate, ammonium hydroxide, urea, and amino acids. Typically, the concentration of the nitrogen sources in the fermentation medium is greater than 0.1 g/L, greater than 0.25 g/L, or greater than 1.0 g/L. Beyond certain concentrations, however, the addition of a nitrogen source to the fermentation medium is not advantageous for the growth of the microorganisms. As a result, the concentration of the nitrogen sources in the fermentation medium is less than 20 g/L, less than 10 g/L, or less than 5 g/L. Further, in some instances it can be desirable to allow the fermentation medium to become depleted of the nitrogen sources during fermentation.

The effective fermentation medium can contain other compounds such as defoamers, inorganic salts, vitamins, trace metals and/or growth promoters. Such other compounds can also be present in carbon, nitrogen or mineral sources in the effective medium or can be added specifically to the medium.

The fermentation medium can also contain a suitable phosphate source. Such phosphate sources include both inorganic and organic phosphate sources. Phosphate sources include, but are not limited to, phosphate salts such as mono or dibasic sodium and potassium phosphates, ammonium phosphate and mixtures thereof. Typically, the concentration of phosphate in the fermentation medium is greater than 1.0 g/L, greater than 2.0 g/L, or greater than 5.0 g/L. Beyond certain concentrations, however, the addition of phosphate to the fermentation medium is not advantageous for the growth of the microorganisms. Accordingly, the concentration of phosphate in the fermentation medium is typically less than 20 g/L, less than 15 g/L, or less than 10 g/L.

A suitable fermentation medium can also include a source of magnesium. In some embodiments, the source of magnesium is in the form of a physiologically acceptable salt, such as magnesium sulfate heptahydrate, although other magnesium sources in concentrations which contribute similar amounts of magnesium can be used. Typically, the concentration of magnesium in the fermentation medium is greater than 0.5 g/L, greater than 1.0 g/L, or greater than 2.0 g/L. Beyond certain concentrations, however, the addition of magnesium to the fermentation medium is not advantageous for the growth of the microorganisms. Accordingly, the concentration of magnesium in the fermentation medium is typically less than 10 g/L, less than 5 g/L, or less than 3 g/L. Further, in some instances it can be desirable to allow the fermentation medium to become depleted of a magnesium source during fermentation.

The fermentation medium can also include a biologically acceptable chelating agent, such as the dihydrate of trisodium citrate or citric acid. In such instance, the concentration of a chelating agent in the fermentation medium is greater than 0.1 g/L, greater than 0.2 g/L, greater than 0.5 g/L, or greater than 1 g/L. Beyond certain concentrations, however, the addition of a chelating agent to the fermentation medium is not advantageous for the growth of the microorganisms. Accordingly, the concentration of a chelating agent in the fermentation medium is typically less than 10 g/L, less than 5 g/L, or less than 2 g/L.

The fermentation medium can also initially include a biologically acceptable acid or base to maintain the desired pH of the fermentation medium. Biologically acceptable acids include, but are not limited to, hydrochloric acid, sulfuric acid, nitric acid, phosphoric acid and mixtures thereof. Biologically acceptable bases include, but are not limited to, anhydrous ammonia, ammonium hydroxide, sodium hydroxide, potassium hydroxide and mixtures thereof. In some embodiments of the present invention, the base used is ammonium hydroxide.

The fermentation medium can also include a biologically acceptable calcium source, including, but not limited to, calcium chloride. Typically, the concentration of the calcium source, such as calcium chloride, dihydrate, in the fermentation medium is within the range of from 5 mg/L to 2000 mg/L, 20 mg/L to 1000 mg/L, or 50 mg/L to 500 mg/L.

The fermentation medium can also include sodium chloride. Typically, the concentration of sodium chloride in the fermentation medium is within the range of from 0.1 g/L to 5 g/L, 1 g/L to 4 g/L, or 2 g/L to 4 g/L.

As previously discussed, the fermentation medium can also include trace metals. Such trace metals can be added to the fermentation medium as a stock solution that, for convenience, can be prepared separately from the rest of the fermentation medium. A suitable trace metals stock solution for use in the fermentation medium is shown below in Tables 1A and 1B. Typically, the amount of such a trace metals solution added to the fermentation medium is greater than 1 mL/L, greater than 5 mL/L, or greater than 10 mL/L Beyond certain concentrations, however, the addition of a trace metals to the fermentation medium is not advantageous for the growth of the microorganisms. Accordingly, the amount of such a trace metals solution added to the fermentation medium is typically less than 100 mL/L, less than 50 mL/L, or less than 30 mL/L It should be noted that, in addition to adding trace metals in a stock solution, the individual components can be added separately, each within ranges corresponding independently to the amounts of the components dictated by the above ranges of the trace metals solution.

As shown below in Table 1A, a suitable trace metals solution for use in the present invention can include, but is not limited to ferrous sulfate, heptahydrate; cupric sulfate, pentahydrate; zinc sulfate, heptahydrate; sodium molybdate, dihydrate; cobaltous chloride, hexahydrate; and manganous sulfate, monohydrate. Hydrochloric acid is added to the stock solution to keep the trace metal salts in solution.

TABLE 1A

TRACE METALS STOCK SOLUTION A

| COMPOUND | CONCENTRATION (mg/L) |
|---|---|
| Ferrous sulfate, heptahydrate | 280 |
| Cupric sulfate, pentahydrate | 80 |
| Zinc (II) sulfate, heptahydrate | 290 |
| Sodium molybdate | 240 |
| Cobaltous chloride, hexahydrate | 240 |
| Manganous sulfate, monohydrate | 170 |
| Hydrochloric acid | 0.1 ml |

Another suitable trace metal solution for use in the present invention is shown in Table 1B and can include, but is not limited to, ferric chloride, hexahydrate; zinc chloride; cobalt chloride, hexahydrate; sodium molybdate; manganese chloride; boric acid; and citric acid as a chelating agent.

TABLE 1B

TRACE METALS STOCK SOLUTION B

| COMPOUND | CONCENTRATION (g/L) |
|---|---|
| Ferric Chloride, hexahydrate | 27 |
| Zinc Chloride | 1.3 |
| Cobalt Chloride, hexahydrate | 2 |
| Sodium molybdate | 2 |
| Manganese Chloride | 3.3 |
| Boric acid | 0.5 |
| Citric acid | 33 |

The fermentation medium can also include vitamins. Such vitamins can be added to the fermentation medium as a stock solution that, for convenience, can be prepared separately from the rest of the fermentation medium. A suitable vitamin stock solution for use in the fermentation medium is shown below in Table 2. Typically, the amount of such vitamin solution added to the fermentation medium is greater than 1 ml/L, greater than 5 ml/L, or greater than 10 ml/L. Beyond certain concentrations, however, the addition of vitamins to the fermentation medium is not advantageous for the growth of the microorganisms. Accordingly, the amount of such a vitamin solution added to the fermentation medium is typically less than 50 ml/L, less than 30 ml/L, or less than 20 ml/L. It should be noted that, in addition to adding vitamins in a stock solution, the individual components can be added separately, each within the ranges corresponding independently to the amounts of the components dictated by the above ranges of the vitamin stock solution.

As shown in Table 2, a suitable vitamin solution for use in the present invention can include, but is not limited to, biotin, calcium pantothenate, inositol, pyridoxine-HCl and thiamine-HCl.

TABLE 2

VITAMIN STOCK SOLUTION

| COMPOUND | CONCENTRATION (mg/L) |
|---|---|
| Biotin | 10 |
| Calcium pantothenate | 120 |
| Inositol | 600 |
| Pyridoxine-HCl | 120 |
| Thiamine-HCl | 120 |

Microorganisms of the present invention can be cultured in conventional fermentation modes, which include, but are not limited to, batch, fed-batch, cell recycle, and continuous. In some embodiments, the fermentation is carried out in fed-batch mode. In such a case, during fermentation some of the components of the medium are depleted. It is possible to initiate the fermentation with relatively high concentrations of such components so that growth is supported for a period of time before additions are required. The preferred ranges of these components are maintained throughout the fermentation by making additions as levels are depleted by fermentation. Levels of components in the fermentation medium can be monitored by, for example, sampling the fermentation medium periodically and assaying for concentrations. Alternatively, once a standard fermentation procedure is developed, additions can be made at timed intervals corresponding to known levels at particular times throughout the fermentation. As will be recognized by those in the art, the rate of consumption of nutrient increases during fermentation, as the cell density of the medium increases. Moreover, to avoid introduction of foreign microorganisms into the fermentation medium, addition is performed using aseptic addition methods, as are known in the art. In addition, a small amount of anti-foaming agent can be added during the fermentation.

The temperature of the fermentation medium can be any temperature suitable for growth and production of chondroitin. For example, prior to inoculation of the fermentation medium with an inoculum, the fermentation medium can be brought to and maintained at a temperature in the range of from 20° C. to 45° C., 25° C. to 40° C., or 28° C. to 32° C.

The pH of the fermentation medium can be controlled by the addition of acid or base to the fermentation medium. In such cases when ammonia is used to control pH, it also conveniently serves as a nitrogen source in the fermentation medium. In some embodiments, the pH is maintained from 3.0 to 8.0, 5.5 to 7.5, or 6.0 to 7.

The fermentation medium can also be maintained to have a constant dissolved oxygen content during the course of fermentation to maintain cell growth and to maintain cell metabolism for production of chondroitin. The oxygen concentration of the fermentation medium can be monitored using known methods, such as through the use of an oxygen electrode. Oxygen can be added to the fermentation medium using methods known in the art, for example, through agitation and aeration of the medium by stirring, shaking or sparging. In some embodiments, the oxygen concentration in the fermentation medium is in the range of from 10% to 200% of the saturation value of oxygen in the medium based upon the solubility of oxygen in the fermentation medium at atmospheric pressure and at a temperature in the range of from 20° C. to 40° C. Periodic drops in the oxygen concentration below this range can occur during fermentation, however, without adversely affecting the fermentation.

Although aeration of the medium has been described herein in relation to the use of air, other sources of oxygen can be used. Particularly useful is the use of an aerating gas which contains a volume fraction of oxygen greater than the volume fraction of oxygen in ambient air. In addition, such aerating gases can include other gases which do not negatively affect the fermentation.

In an embodiment of the fermentation process of the present invention, a fermentation medium is prepared as described above. This fermentation medium is inoculated with an actively growing culture of genetically modified microorganisms of the present invention in an amount sufficient to produce, after a reasonable growth period, a high cell density. Typical inoculation cell densities are within the range of from 0.001 g/L to 10 g/L, 0.01 g/L to 5 g/L, or 0.05 g/L to 1.0 g/L, based on the dry weight of the cells. In production scale fermentors, however, greater inoculum cell densities are preferred. The cells are then grown to a cell density in the range of from 10 g/L to 150 g/L, 20 g/L to 80 g/L, or 50 g/L to 70 g/L. The residence times for the microorganisms to reach the desired cell densities during fermentation are typically less than 200 hours, less than 120 hours, or less than 96 hours.

In one mode of operation of the present invention, the carbon source concentration, such as the glycerine concentration, of the fermentation medium is monitored during fermentation. Glycerine concentration of the fermentation medium can be monitored using known techniques, such as, for example, use of the high pressure liquid chromatography, which can be used to monitor glycerine concentration in the supernatant, e.g., a cell-free component of the fermentation medium. As stated previously, the carbon source concentration should be kept below the level at which cell growth inhibition occurs. Although such concentration can vary from organism to organism, for glycerine as a carbon source, cell growth inhibition occurs at glycerine concentrations greater than at about 60 g/L, and can be determined readily by trial. Accordingly, when glycerine is used as a carbon source the glycerine is preferably fed to the fermentor and maintained below detection limits. Alternatively, the glycerine concentration in the fermentation medium is maintained in the range of from 1 g/L to 100 g/L, 2 g/L to 50 g/L, or 5 g/L to 20 g/L. Although the carbon source concentration can be maintained within desired levels by addition of, for example, a substantially pure glycerine solution, it is acceptable to maintain the carbon source concentration of the fermentation medium by addition of aliquots of the original fermentation medium. The use of aliquots of the original fermentation medium can be desirable because the concentrations of other nutrients in the medium (e.g. the nitrogen and phosphate sources) can be maintained simultaneously. Likewise, the trace metals concentrations can be maintained in the fermentation medium by addition of aliquots of the trace metals solution.

Chondroitin Recovery

Once chondroitin is produced by a fermentation methodology, it can be recovered for subsequent use. The present inventors have shown that chondroitin can be present in a cell-free form in culture media ("secreted chondroitin") and/ or associated with the cells. Chondroitin that is associated with the cells can be associated with the cell surface ("cell-surface chondroitin") and/or retained within the cell ("intracellular chondroitin").

With respect to "secreted chondroitin," the recovery of chondroitin can be accomplished by cell removal followed by alcohol precipitation of the cell-free culture media, or any technique known in the art, including without limitation, lyophilization of the cell-free culture media to obtain dry powder.

With respect to "cell-surface chondroitin," the recovery of chondroitin can additionally include a step of detaching the chondroitin from the cell surface followed by a cell removal step that removes the cells from the culture media that contains the free chondroitin. With respect to "intracellular chondroitin," the recovery can additionally include a step of permeabilizing or lysing the cells, followed by a step that accomplishes removal of the lysed or permeabilized cells from the culture media that now contains the liberated chondroitin. Chondroitin can be recovered from the culture media by alcohol precipitation of the culture media, or any technique known in the art, including without limitation, lyophilization of the culture media to obtain dry powder.

Additionally, the recovered chondroitin polymer can be depolymerized to reduce the molecular weight of the polymer. Depolymerization of a chondroitin can be accomplished by any technique known in the art, including without limitation, acidic depolymerization. See, for example, Tommeraas and Melander, *Biomacromolecules* 2008; 9:1535-1540. A recovered chondroitin can be depolymerized, for example, to produce a chondroitin with a similar or identical molecular weight to an animal-derived chondroitin and/or to aid in sulfation of a recovered non-sulfated chondroitin. For example, a recovered chondroitin can be depolymerized to obtain a polymer with a molecular weight of 5 kDa to 100 kDa, preferably, 10 kDa to 70 kDa, more preferably, 20 kDa to 40 kDa.

The following definitions and abbreviations are to be used for the interpretation of the claims and the specification.

As used herein the term "gene" refers to a nucleic acid fragment (or polynucleotide) that is capable of being expressed as a specific protein, optionally including regulatory sequences preceding (5' non-coding sequences) and following (3' noncoding sequences) the coding sequence. "Native gene" refers to a gene that is found in nature with its own regulatory sequences. "Endogenous gene" refers to a native gene in its natural location in the genome of an organism.

As used herein the term "coding sequence" refers to a DNA sequence that codes for a specific amino acid sequence.

"Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, translation leader sequences, introns, polyadenylation recognition sequences, RNA processing sites, effector binding sites and stem-loop structures.

The term "promoter" refers to a DNA sequence capable of controlling the expression of a coding sequence or functional RNA. In general, a coding sequence is located 3' to a promoter sequence. Promoters can be derived in their entirety from a native gene, or be composed of different elements derived from different promoters found in nature, or even comprise synthetic DNA segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths can have identical promoter activity.

The term "expression", as used herein, refers to the transcription and stable accumulation of sense (mRNA) or antisense RNA derived from the nucleic acid fragment of the invention. Expression can also refer to translation of mRNA into a polypeptide.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "construct," "plasmid", "vector" and "cassette" refer to an extra chromosomal element often carrying genes which are not part of the central metabolism of the cell, and usually in the form of circular, or linear, double stranded DNA fragments. Such elements can be autonomously replicating sequences, genome integrating sequences, phage or nucleotide sequences, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without variation in the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA.

The term "operably linked" refers to the association of nucleic acid sequences on a single nucleic add fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

Standard recombinant DNA and molecular cloning techniques used herein are well known in the art and are described by Sambrook, J., Fritsch, E. F. and Maniatis, T., Molecular Cloning: A Laboratory Manual, Second Edition, Cold Spring Harbor Laboratory Press, Cold Spring Harbor, N.Y. (1989) (hereinafter "Maniatis"); and by Silhavy, T. J., Berman, M. L. and Enquist, L. W., Experiments with Gene Fusions, Cold Spring Harbor Laboratory Press, Cold Spring Harbor, N.Y. (1984); and by Ausubel, F. M. et al., Current Protocols in Molecular Biology, published by Greene Publishing Assoc. and Wiley-Interscience (1987). Each of these documents is incorporated by reference herein in there entirety.

Additional objects, advantages, and novel features of this invention will become apparent to those skilled in the art upon examination of the following examples thereof, which are not intended to be limiting.

EXAMPLES

Example 1

Genetics of K4 Capsule Biosynthesis

The *E. coli* K4 capsule is categorized as a "group 2" capsule. As reviewed by Whitfield (*Annu Rev Biochem.* 2006; 75:39-68), the synthesis of *E. coli* group 2 capsules is directed by a set of proteins encoded by gene clusters having a common genetic organization consisting of three regions. The predicted structure (prior to the current invention) of the *E. coli* K4 capsule gene cluster is shown in the FIG. 2. Region 1 was expected to contain six genes, kpsFEDUCS, and region 3 was expected to contain two genes, kpsM and kpsT. Based on sequence homology with known proteins, kpsF and kpsU genes were predicted to encode proteins that catalyze steps in the biosynthesis of the sugar nucleotide CMP-Kdo. A role of CMP-Kdo biosynthesis of group 2 capsules in *E. coli* has been proposed (Roberts, *Annu. Rev. Microbiol.* 1996; 50:285-315) but has not been demonstrated experimentally (Whitfield, *Annu Rev Biochem.* 2006; 75:39-68). The kpsM, kpsT, kpsD, kpsE, kpsC and kpsS genes were posited to encode proteins required for translocation of the capsular polysaccharide from the cell cytoplasm, where polymerization of sugar precursors occurs, to the cell surface where the mature capsular polysaccharide is believed to be anchored to the outer cell membrane through a covalent linkage to a lipid component of that membrane (Roberts, *Annu. Rev. Microbiol.* 1996; 50:285-315; Whitfield, *Annu Rev Biochem.* 2006; 75:39-68). For the *E. coli* K4 capsule, as for most *E. coli* group 2 capsules, the structure of the covalent linkage between the polysaccharide and the lipid component of the capsule has not been determined experimentally. Moreover, the identity of the lipid component is not known. The region 1 and region 3 genes, and the proteins that they encode, are highly conserved among *E. coli* strains that produce capsules having very diverse polysaccharide compositions and structures (Whitfield, *Annu Rev Biochem.* 2006; 75:39-68). The genes contained in region 2 of group 2 capsule clusters in *E. coli* include genes that encode enzymes for sugar nucleotide precursor biosynthesis and for polymerization of these precursors, and region 2 thereby determines the structure of the capsular polysaccharide. Other genes in region 2 of group 2 capsule clusters in *E. coli* encode proteins for which functions are unknown and have not been demonstrated to have a role in capsule biosynthesis. The sequence of region 2 of the *E. coli* K4 capsule gene cluster as described by Ninomiya et al. (*J. Biol. Chem.* 2002; 277:21567-21575, GenBank AB079602) contains 7 annotated open reading frames (kfoABCDEFG) predicted to encode proteins. An insertion element, IS2, is located between genes kfoC and kfoD.

As a preliminary step in design of synthetic coding sequences for the K4 capsule biosynthetic genes, the intergenic sequences separating each gene pair were examined. Based on this sequence analysis, it appeared likely that there were, within this region, at least two additional open-reading-frames (ORFs) encoding proteins that are likely to be expressed and potentially related to capsule biosynthesis. Based on the Ninomiya et al. sequence, the following intergenic distances were obtained: kfoA-kfoB: 186 bp; kfoB-kfoC: 297 bp; kfoC-IS2: 29 bp; IS2-kfoD: 9 bp; kfoD-kfoE:

389 bp; kfoE-kfoF: 818 bp; kfoF-kfoG: 431 bp. One open reading frame was identified in each of the three largest intergenic regions.

Figure 3A:
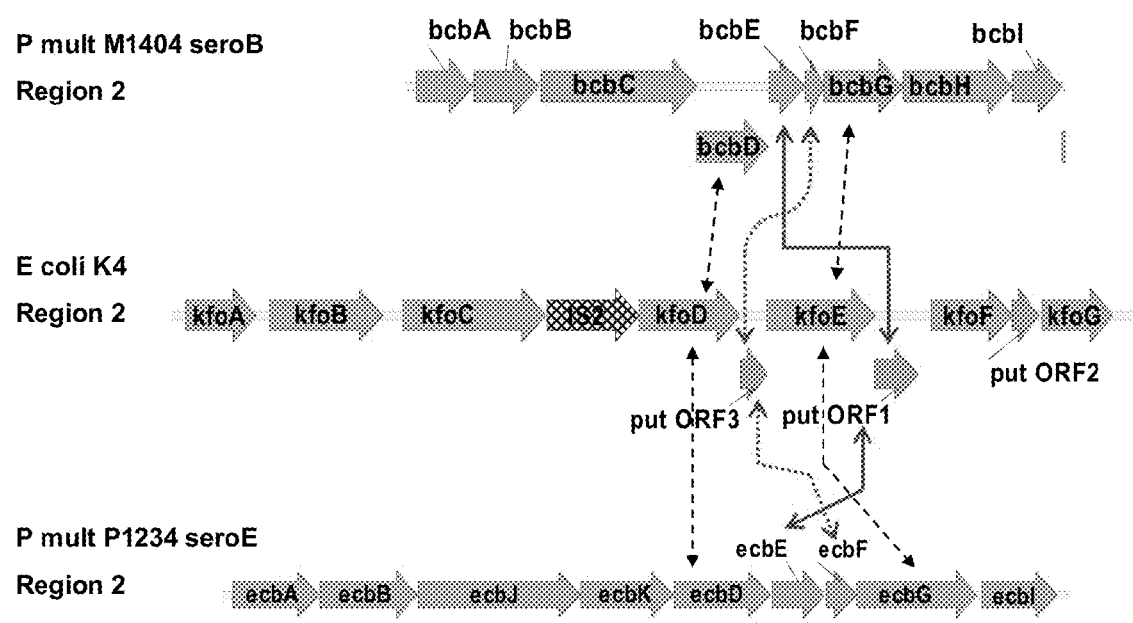
FIG. 3A shows the presence of additional putative coding sequences orf1, orf2 and orf3, and further shows that based on sequence alignment of region 2 from *E. coli* K4 with *P. multocida* serotypes B and E; genes (alignment data shown in FIG. 3B), kfoD, orf3, kfoE, orf1, from *E. coli* K4 have homologs among the *P. multocida* M1404 serotype B genes bcbDEFG and the *P. multocida* P1234 serotype E genes ecbDEFG. Homologs are connected by two-headed arrows.

Most of the kfoD-kfoE region is encompassed by a 390 bp ORF, termed "ORF3", which initiates 10 nucleotides after the stop codon of kfoD and terminates within the coding region of kfoE. That is, the putative orf3 gene overlaps the kfoE gene by 10 nucleotides. This ORF is initiated by an ATG and a second possible ATG start is located, in frame, 9 bp downstream. Both of these possible starts lack a recognizable Shine-Dalgarno (SD) sequence (Shine and Dalgarno Proc. Natl. Acad. Sci. USA. 1974; 71:1342-6). When the protein product of orf3 was used in a BLAST search, 8 "good" hits, i.e. Scores>138, E values<3e-31 were obtained. Two of these hits were to proteins encoded by Pasteurella multocida genes (bcbF & ecbF) located in gene clusters for capsule biosynthesis. These P. multocida capsule gene clusters are diagrammed in FIG. 3A along with the K4 region 2 genes according to the sequence of Ninomiya et al. as analyzed by the present inventors. Alignment of protein sequences for Orf3, BcbF and EcbF proteins is shown in FIG. 3B. These P. multocida sequences come from a serotype B strain (M1404) and a serotype E strain (P1234), respectively. Composition of the serotype E capsule is unknown while the serotype B capsule is reported to be composed of mannose, galactose and arabinose but no structure has been reported (Townsend et al., J. Clin. Microbiol. 2001; 39:924-929).

In the kfoE-kfoF region, a 630 bp ORF termed "ORF1" is present as shown in FIG. 3A. The ATG start codon for this ORF overlaps with the TGA stop codon of the upstream kfoE gene. Seven base pairs upstream of this ATG, within the coding sequence for KfoE, a strong SD sequence (AGGAGG) is present. Thus, the circumstantial evidence is strong that this ORF should be expressed. BLAST results for the protein encoded by ORF1 include strong hits to P. multocida genes (bcbE & ecbE) that are adjacent to the P. multocida gene hits obtained with ORF3. That is, both putative ORFs 1 and 3 of the K4 cluster have homologs within two P. multocida gene clusters encoding capsular polysaccharides. Alignment of ORF1, BcbE and EcbE protein sequences is shown in FIG. 3B.

In the kfoF-kfoG region, a 384 bp ORF, termed "ORF2" is present. The ATG start codon of this ORF is preceded by a GG sequence 15 bp upstream, which could provide a weak SD sequence. No significant hits were found in BLAST searches with this protein sequence. This suggested that this ORF may not encode a polypeptide that is actually produced.

It is interesting to note that two other K4 capsule cluster genes from region 2 (kfoD and kfoE) have homology to P. multocida genes located in the P. multocida P1234 and P. multocida M1404 capsule gene clusters. The protein encoded by kfoD shares homology with EcbD and BcbD and similarly the kfoE gene product shares homology with EcbG and BcbG. Thus, as shown in FIG. 3A, the four contiguous K4 genes (kfoD, orf3, kfoE, and orf1) have homologs among the contiguous P. multocida serotype B genes bcbDEFG and the P. multocida serotype E genes ecbDEFG. As noted above, these two Pasteurella strains are not chondroitin producers and the role, if any, which the K4 genes kfoD, orf3, kfoE, and orf1 play in chondroitin biosynthesis was unknown prior to this invention.

The fact that the kfoD, orf3, kfoE, orf1 gene set in K4 is immediately (9 bp) preceded by IS2 raises numerous possibilities regarding their origin and role in chondroitin capsule synthesis. Without wishing to be bound by theory, the present inventors contemplate that the K4 region 2 gene cluster has arisen via IS2-mediated recombination/insertion into a parental, chondroitin-producing, cluster comprised of kfoABCFG. Further, the present inventors hypothesized that the kfoD, orf3, kfoE and orf1 genes might be involved in the fructosylation of the chondroitin backbone. The fructosylation is the one obvious structural difference between the P. multocida serotype F capsule and the E. coli K4 capsule. It is possible that the significant difference in genetic structure between the two, i.e. the presence or absence of the kfoD, orf3, kfoE, orf1 gene set, is a reflection of that structural difference. By analogy to the capsule biosynthetic gene cluster of the P. multocida chondroitin-producing serotype F strain P4182 (Townsend et al., J. Clin. Microbiol. 2001; 39:924-929), it may be possible that the only relevant K4 region 2 genes for production of the chondroitin backbone might be kfoA, kfoB, kfoC, kfoF and kfoG. As described in Examples 6 and 7, the present inventors confirmed that the kfoD, orf3, kfoE and orf1 genes are not required for production of chondroitin and that one or more of these genes is essential for fructosylation of chondroitin.

Figure 4B:
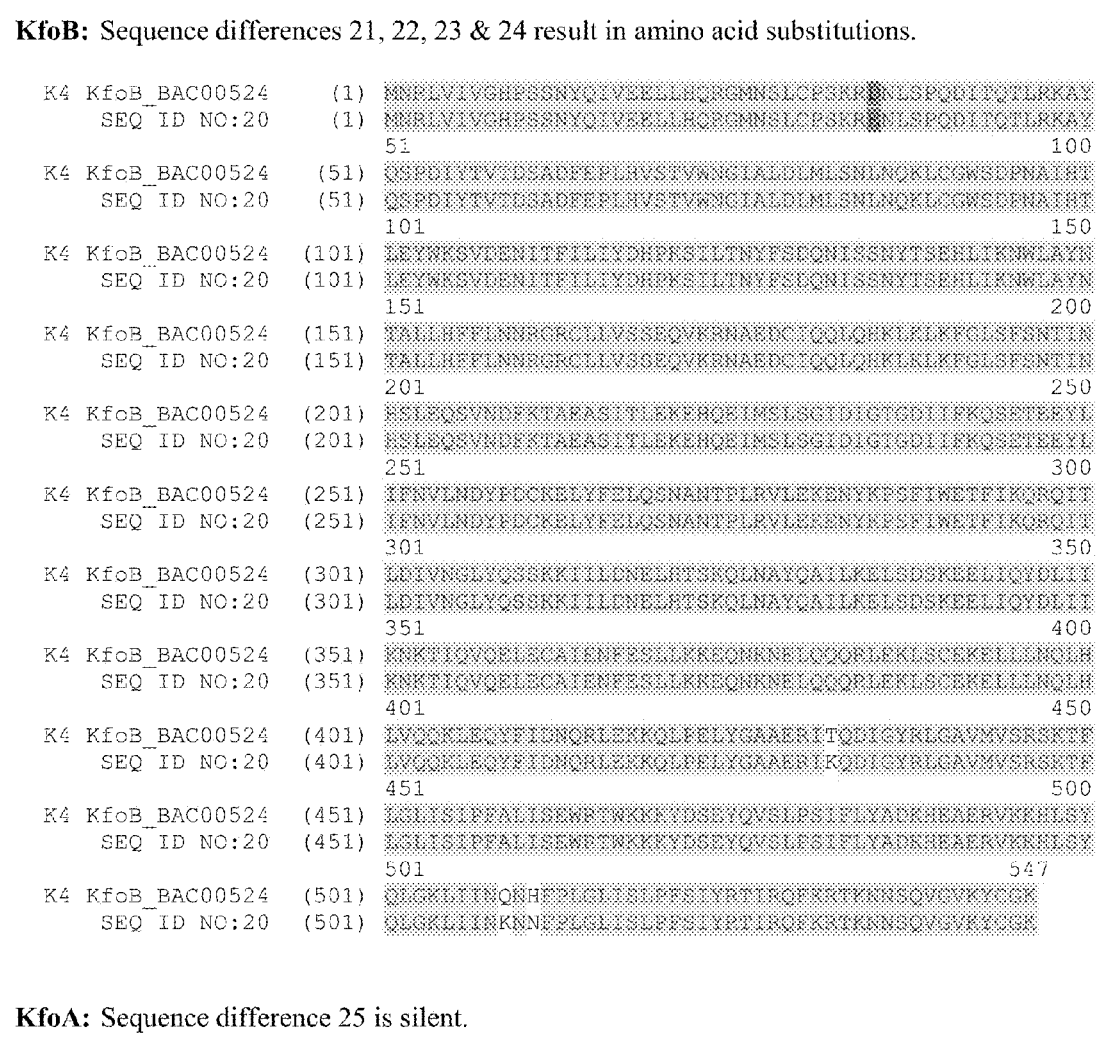

In order to confirm the Ninomiya et al. sequence prior to designing synthetic coding sequences for the K4 capsule biosynthetic genes, the present inventors sequenced region 2 of the K4 capsule gene cluster from the E. coli K4 strain ATCC 23502 obtained from ATCC. Genomic DNA was prepared from a fresh overnight culture of ATCC strain 23502 using the Qiagen Genomic DNA Kit (Qiagen Inc., Valencia, Calif.) according to the vendor protocol. Aliquots of genomic DNA, sheared by passage (five times) through a 20 gauge needle were used as template in PCR reactions to produce a series of 6 overlapping PCR products ranging in size from 2.2 kB to 2.7 kB. The products of the PCR reactions were purified using the Qiagen QIAquick PCR Purification Kit according to the vendor protocol and sent to a commercial vendor (Biotechnology Resource Center, DNA Sequencing Facility, Cornell University, Ithaca, N.Y.) for DNA sequence determination. The sequences of these 6 overlapping PCR products spanned the region 2 sequence as determined by Ninomiya et al. (2002). On the whole, there was agreement between the sequence determined by the inventors and the sequence reported by Ninomiya et al. with a 99.8% identity. However, there were single base pair differences, including substitutions, deletions and insertions, at 26 positions. Some of these differences resulted in substantial differences in the predicted amino acid sequences of region 2 proteins encoded by the gene cluster. The observed nucleotide sequence differences and resulting effect on predicted protein sequences are shown in FIGS. 4A and 4B.

In order to determine the correct sequence of the K4 capsule biosynthetic genes, E. coli serotype K4 strain U1-41 was obtained from the Statens Serum Institut (Copenhagen, Denmark). U1-41 is the progenitor of the ATCC 23502 strain and was used to produce the polysaccharide preparation used for structural determination of the K4 polysaccharide (Rodriguez et al., 1988). The sequence of approximately 23 kb of DNA spanning regions 1, 2 and 3 of the K4 capsule gene cluster in E. coli U1-41 was determined. This sequence (SEQ ID NO:117) consists of 23,230 base pairs spanning a region from 125 bp upstream of the ATG translational start codon of the kpsF gene of region 1 to 110 bp upstream of the ATG translational start codon of the kpsM gene of region 3.

For sequence determination, genomic DNA was prepared from a fresh overnight culture of E. coli U1-41 using the Qiagen Genomic DNA Kit (Qiagen Inc., Valencia, Calif.) according to the vendor protocol. Aliquots of genomic DNA, sheared by passage (five times) through a 20 gauge needle was used as template in PCR reactions to produce a series of 11 overlapping PCR products ranging in size from 2.1 kB to 2.8 kB. These PCR reactions, termed here Reactions 1 through 11, employed the following oligonucleotide primers: Reaction 1; (DHD089 and DHD090), Reaction 2; (DHD091 and DHD092), Reaction 3; (DHD093 and DHD175), Reaction 4; (DHD120 and DHD096), Reaction 5; (DHD097 and DHD098), Reaction 6; (DHD099 and DHD100), Reaction 7; (DHD101 and DHD102), Reaction 8; (DHD103 and DHD104), Reaction 9; (DHD105 and DHD106), Reaction 10; (DHD162 and DHD108), Reaction 11; (DHD169 and DHD110). Sequences of these primers are shown below.

```
DHD089
                                        (SEQ ID NO: 118)
5> GCACCTCCATGAGACATTGC >3

DHD090
                                        (SEQ ID NO: 119)
5> CCACTGCCATACGGTTTAGC >3

DHD091
                                        (SEQ ID NO: 120)
5> GCTTGCCTTTGCAGAAACGG >3

DHD092
                                        (SEQ ID NO: 121)
5> CCAACAATATCGAGCAGTGG >3

DHD093
                                        (SEQ ID NO: 122)
5> GTCATTCGTCAGAACGGTGC >3

DHD175
                                        (SEQ ID NO: 123)
5> CCAGTGCCTGATAATCAGC >3

DHD120
                                        (SEQ ID NO: 124)
5> GGCTTAACGCTGTGGAAGTC >3

DHD096
                                        (SEQ ID NO: 125)
5> ATATTGGGATTCCTGGTCGC >3

DHD097
                                        (SEQ ID NO: 126)
5> ACGACATCAAAGGCTTGACG >3

DHD098
                                        (SEQ ID NO: 127)
5> ATAGCCCTGAAGCTGAAGCC >3

DHD099
                                        (SEQ ID NO: 128)
5> CGAGTGATTGCTTGGTATCC >3

DHD100
                                        (SEQ ID NO: 129)
5> AAACGATTGAGCGGGTTAGC >3

DHD101
                                        (SEQ ID NO: 130)
5> AGAGTGGTTCAATCCTCTGG >3

DHD102
                                        (SEQ ID NO: 131)
5> TGTCTTGGCTAATGCTGACG >3

DHD103
                                        (SEQ ID NO: 132)
5> CGAGTAGTTATCTGGCTCTG >3

DHD104
                                        (SEQ ID NO: 133)
5> GTCAGTTAGACTCTGATGAC >3

DHD105
                                        (SEQ ID NO: 134)
5> CTTGAACGGTCCAACTTCAC >3
```

-continued

```
DHD106
                                        (SEQ ID NO: 135)
5> AGTTCAGGAGCTTGAATGCG >3

DHD162
                                        (SEQ ID NO: 136)
5> TTCGCACGCATTTATAGCCG >3

DHD108
                                        (SEQ ID NO: 137)
5> TCATCTTGCGAGAGCATTCG >3

DHD169
                                        (SEQ ID NO: 138)
5> CTTCCGCTAAATCCATTACG >3

DHD110
                                        (SEQ ID NO: 139)
5> AGATCTATTTATCCCTGCGG >3
```

PCR Reactions 1, 2, 3, 7, 8, 9, 10 and 11 were performed using PfuUltra II polymerase (STRATAGENE, LaJolla, Calif.) according to the vendor protocols. In each 100 μL reaction, Pfu reaction buffer (supplied by the vendor) was added to a final concentration of 1×, primers were added to a final concentration of 0.4 μM each, dNTPs were added at a final concentration of 250 μM each and 100 ng of U1-41 genomic DNA was added as template. PCR reactions were performed in a Perkin-Elmer GeneAmp 2400 thermocyler using the following cycling parameters: 1 cycle of 2 minutes at 95° C.; 35 cycles of 20 seconds at 95° C., 20 seconds at 55° C., and 40 seconds at 72° C.; 1 cycle of 3 minutes at 72° C.; and a hold at 4° C. PCR Reactions 4, 5 and 6 were performed as above with the following exceptions. In the case of Reactions 5 and 6, the primers were added to a final concentration of 0.5 μM each and the annealing step was at 60° C. instead of 55° C. In the case of Reaction 4, primers were added to a final concentration of 0.5 μM each and PCR reactions were performed in a RoboCycler® Gradient 96 thermocycler (STRATAGENE, LaJolla, Calif.) using the following cycling parameters: 1 cycle of 1 minute at 95° C.; 35 cycles of 30 seconds at 95° C., 30 seconds at 52° C., and 1 minute at 72° C.; 1 cycle of 5 minutes at 72° C.; and a hold at 6° C.

The products of PCR Reactions 1, 2, 3, 7, 8, 9, 10 and 11 were purified using the Qiagen QIAquick PCR Purification Kit (QIAGEN, Valencia, Calif.) according to the vendor protocol, recovered in 100 μL of EB elution buffer, and then used as templates for sequencing reactions. Products of PCR Reactions 4, 5 and 6 were purified using the Qiagen QIAquick PCR Purification Kit (QIAGEN, Valencia, Calif.) according to the vendor protocol and then further purified by preparative agarose gel electrophoresis. Fragments were excised from the gels and eluted from the gel slices using the QIAquick Gel Extraction Kit (QIAGEN Inc., Valencia, Calif.) according to the vendor protocol and recovered in 100 μL of EB elution buffer. The gel-purified fragments served as templates for sequencing reactions. The purified PCR products of reactions 1-11 were sent to a commercial vendor (Cornell University Life Sciences Core Laboratories Center, Cornell University, Ithaca, N.Y.) for DNA sequence determination. The sequences obtained from these 11 overlapping PCR products spanned the region 2 sequence as determined by Ninomiya et al. (2002) and included all of the region 1 and region 3 genes as well.

The sequence of the K4 capsule gene cluster from U1-41 demonstrates the presence of kpsF, kpsE, kpsD, kpsU, kpsC and kpsS genes in region 1 as is typical for group 2 capsule gene clusters in *E. coli*. The predicted amino acid sequences of U1-41 KpsF, KpsE, KpsD, KpsU, KpsC and KpsS proteins are homologous to the sequences of these proteins encoded by other *E. coli* group 2 capsule producers. They all show >95% identity to the consensus sequences for these proteins and to the *E. coli* Nissle 1917 (serotype K5) KpsF, KpsE, KpsD, KpsU, KpsC and KpsS sequences (Grozdanov et al., *J. Bacteriol.* 2004; 186:5432-41). The sequence also reveals the presence of kpsM and kpsT genes in region 3 as is typical for group 2 capsule gene clusters in *E. coli*. The predicted amino acid sequences of U1-41 KpsM and KpsT proteins are homologous to the sequences of these proteins encoded by other *E. coli* group 2 capsule producers. They all show >90% identity to the consensus sequences for these proteins and to the *E. coli* Nissle 1917 (serotype K5) KpsM and KpsT sequences.

Figure 5:
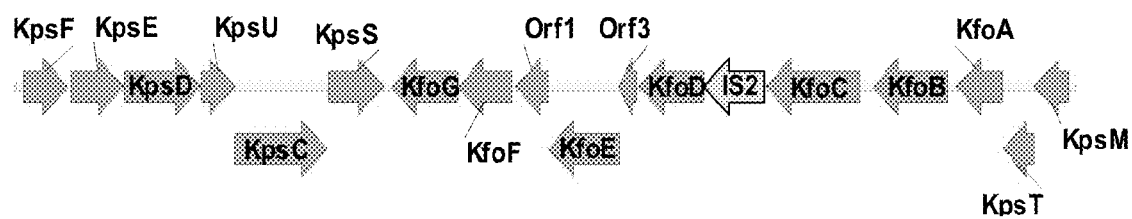
FIG. 5 shows the organization of the K4 capsule gene cluster from the *E. coli* K4 strain U1-41. The gene cluster contains 17 open reading frames (exclusive of IS2) that are predicted to encode proteins.

The U1-41 DNA sequence includes an approximately 13.5 kb region 2 segment that can be aligned to the Ninomiya et al. region 2 sequence and to the sequence determined by the present inventors for region 2 of ATCC 23502. The U1-41 sequence and the sequence determined by the present inventors for region 2 of ATCC 23502 are identical over this span. Nine open reading frames (ORFs) predicted to be expressed as polypeptides are present in the identified region 2, exclusive of the IS2 sequence. These nine include the two ORFs, detailed above, that were not previously identified. The genes encoding these ORFs were initially termed here orf1 and orf3 and are now proposed to be designated as kfoH and kfoI, respectively. FIG. 5 shows the arrangement of the K4 capsule gene cluster as determined by the present inventors from the DNA sequences of ATCC 23502 and U1-41. Orf2 mentioned above was not found to exist as a separate open reading frame in the sequence of region 2 as determined by the present inventors. In the sequence as determined by the present inventors, the sequences comprising orf2 are a portion of the coding sequence of kfoG. Frameshifts within the sequence published by Ninomiya et al. split the kfoG sequence into two smaller open reading frames; the kfoG gene as annotated by Ninomiya et al. and the orf2 sequence as annotated by the present inventors. Thus, orf2 was an artifact of the erroneous sequence published by Ninomiya et al.

Exclusive of the IS2 sequence, the gene cluster contains 17 open reading frames that are predicted to encode proteins. The arrangement of these genes is typical for an *E. coli* group 2 capsule gene cluster (Whitfield 2006). Region 1, comprising conserved genes kpsFEDUCS, and region 3, comprising conserved genes kpsMT, flank the 9 open reading frames (and IS2) of region 2. Region 1 and region 3 genes include proteins that are required for synthesis and translocation of all group 2 capsules in *E. coli*. Region 1 also includes two genes (kpsF and kpsU) that encode enzymes that are predicted to catalyze steps in the biosynthesis of CMP-Kdo. As noted above, a role of CMP-Kdo in biosynthesis of group 2 capsules in *E. coli* has been proposed, but has not been demonstrated experimentally. In group 2 capsule gene clusters, region 2 genes typically include those that encode serotype-specific proteins that determine the structure of the capsular polysaccharide. Of the nine genes identified in region 2, three encode proteins with clearly defined activities relating to capsule biosynthesis: kfoC (chondroitin synthase, i.e., the polymerase), kfoA (UDPGlcNAc epimerase, converts UDPGlcNAc to the UDPGalNAc precursor) and kfoF (UDPGlc-dehydrogenase, converts UDPGlc to the UDPGlcUA precursor).

Functions remain unknown for other genes present in region 2 of the K4 capsule gene cluster: kfoB, kfoG, kfoD, kfoE, kfoH and kfoI. The kfoB encodes a protein that is homologous to proteins encoded by genes present in capsule clusters of bacteria known to produce other glycosaminoglycan (GAG) capsules, *P. multocida* serotypes A, F and D and *E. coli* serotype K5. Similarly the KfoG protein also has homology to proteins encoded by genes present in the capsule clusters of *P. multocida* serotypes A, F and D. This circumstantial evidence suggests that kfoB and kfoG can play a role in the biosynthesis of the GAG-containing K4 capsule.

In contrast to KfoB and KfoG, prior to this invention, no such evidence implicated kfoD, kfoE, kfoH and kfoI as being involved in GAG biosynthesis. As noted above and described in Examples 6 and 7, the present inventors show herein that one or more of these genes (i.e. genes kfoD, kfoE, kfoH and kfoI) is essential for fructosylation of the chondroitin backbone of the K4 capsular polysaccharide, but that none of these genes are required for production of the chondroitin backbone.

The insertion element IS2 is present between genes kfoC and kfoD in U1-41 as well as in ATCC 23502. Insertion of IS2 in the observed orientation has been reported to activate expression of downstream genes due to transcription that originates within IS2 (Glansdorf et al., *Cold Spring Harbor Symp. Quant. Biol.*, 1981; 45:153-156). Thus, without wishing to be bound by theory, it is proposed that the presence of IS2 could modulate expression of downstream genes kfoD, kfoI, kfoE, kfoH, kfoF and kfoG, but is not predicted to prevent expression of these genes.

Example 2

Synthesis of Codon-optimized *E. coli* K4 Capsule Biosynthetic Genes

The sequence of the U1-41 K4 capsule gene cluster as determined by the present inventors was used as the basis for the design of synthetic genes to be used for expression in alternative hosts. Synthetic constructs were designed to allow the expression of one or more synthetic operons containing the K4 capsule biosynthetic genes and were optimized for codon usage based on a consensus preferred codon table that employs codons that are acceptable for expression in *E. coli*, *X. campestris, S. elodea* and *B. subtilis*. Table 3A gives codon usage tables for *E. coli, X. campestris* and *B. subtilis* genomes as well as for *E. coli* K4 region 2 genes related to K4P capsule biosynthesis, and 53 *S. elodea* genes including those related to gellan biosynthesis. This table illustrates the striking use of unfavorable codons in the K4 region 2 biosynthetic genes. These codons are not only extremely unfavorable for *X. campestris* or *S. elodea* expression but are also unfavorable for expression in *E. coli*. For optimal expression in *E. coli*, it would be expected that significant codon optimization would be necessary. Based on comparison of these codon usage tables, a consensus preferred codon usage table was designed, shown in Table 3B for the synthetic chondroitin biosynthetic genes. This codon usage pattern is expected to provide efficient translation in a wide variety of potential alternative hosts.

TABLE 3A

| CODON USAGE | | | | | |
|---|---|---|---|---|---|
| Amino acid | codon | B. subtilis genome | X. campestris genome | S. elodea 53 CDSs | E coli K-12 genome | E. coli K4 kfoA-G |
| arg | cgg | 16 | 15 | 22 | 10 | 5 |
|  | cga | 10 | 3 | 4 | 6 | 16 |
|  | cgt | 18 | 15 | 9 | 38 | 22 |
|  | cgc | 21 | 66 | 63 | 40 | 9 |
|  | agg | 10 | 2 | 2 | 2 | 12 |
|  | aga | 26 | 1 | <1 | 4 | 36 |

TABLE 3A-continued

CODON USAGE

| Amino acid | codon | B. subtilis genome | X.campestris genome | S. elodea 53 CDSs | E coli K-12 genome | E. coli K4 kfoA-G |
|---|---|---|---|---|---|---|
| ser | tcg | 10 | 29 | 39 | 15 | 7 |
|  | tca | 24 | 3 | 2 | 12 | 25 |
|  | tct | 20 | 3 | 2 | 15 | 25 |
|  | tcc | 13 | 18 | 18 | 15 | 8 |
|  | agt | 11 | 7 | 5 | 15 | 23 |
|  | agc | 23 | 40 | 34 | 28 | 11 |
| leu | ctg | 24 | 65 | 55 | 50 | 7 |
|  | cta | 5 | 2 | 2 | 4 | 12 |
|  | ctt | 24 | 4 | 7 | 10 | 19 |
|  | ctc | 1 | 13 | 30 | 10 | 4 |
|  | ttg | 16 | 16 | 5 | 10 | 16 |
|  | tta | 20 | 1 | 1 | 13 | 42 |
| gly | ggg | 16 | 12 | 16 | 15 | 19 |
|  | gga | 31 | 4 | 5 | 11 | 34 |
|  | ggt | 18 | 13 | 9 | 34 | 36 |
|  | ggc | 34 | 71 | 70 | 30 | 11 |
| val | gtg | 26 | 66 | 47 | 37 | 8 |
|  | gta | 20 | 4 | 5 | 15 | 29 |
|  | gtt | 28 | 5 | 6 | 26 | 53 |
|  | gtc | 26 | 25 | 42 | 22 | 10 |
| ala | gcg | 26 | 38 | 46 | 36 | 11 |
|  | gca | 28 | 13 | 8 | 21 | 42 |
|  | gct | 25 | 5 | 4 | 16 | 34 |
|  | gcc | 21 | 44 | 43 | 27 | 13 |
| thr | acg | 27 | 26 | 34 | 27 | 15 |
|  | aca | 41 | 5 | 3 | 13 | 47 |
|  | act | 16 | 5 | 3 | 17 | 27 |
|  | acc | 16 | 63 | 60 | 44 | 11 |
| pro | ccg | 43 | 62 | 59 | 52 | 9 |
|  | cca | 19 | 9 | 3 | 19 | 33 |
|  | cct | 29 | 6 | 4 | 16 | 37 |
|  | ccc | 9 | 23 | 34 | 12 | 13 |
| ile | ata | 13 | 1 | 2 | 7 | 45 |
|  | att | 50 | 16 | 8 | 51 | 45 |
|  | atc | 37 | 83 | 90 | 42 | 10 |
| glu | gag | 32 | 51 | 65 | 31 | 23 |
|  | gaa | 68 | 49 | 35 | 69 | 77 |
| asp | gat | 64 | 37 | 35 | 63 | 83 |
|  | gac | 36 | 63 | 65 | 37 | 17 |
| lys | aag | 30 | 84 | 90 | 23 | 21 |
|  | aaa | 70 | 16 | 10 | 77 | 79 |
| asn | aat | 57 | 28 | 28 | 45 | 78 |
|  | aac | 43 | 72 | 72 | 55 | 22 |
| cys | tgt | 45 | 14 | 8 | 45 | 65 |
|  | tgc | 55 | 86 | 92 | 55 | 35 |
| tyr | tat | 65 | 32 | 61 | 57 | 80 |
|  | tac | 35 | 68 | 39 | 43 | 20 |
| phe | ttt | 68 | 21 | 11 | 57 | 79 |
|  | ttc | 32 | 79 | 89 | 43 | 21 |
| gln | cag | 49 | 83 | 91 | 65 | 26 |
|  | caa | 51 | 17 | 9 | 35 | 74 |
| his | cat | 67 | 39 | 48 | 57 | 84 |
|  | cac | 33 | 61 | 52 | 43 | 16 |
| met | atg | 100 | 100 | 100 | 100 | 100 |
| trp | tgg | 100 | 100 | 100 | 100 | 100 |

Values shown reflect the occurrence as a percentage, for each codon, of the total codons that specify the given amino acid that the codon encodes. Codon usages were calculated from the genome of B. subtilis strain 168, X. campestris pv. campestris ATCC33913, E. coli K-12 W3110 and Sphingomonas elodea 53 CDSs containing 20,972 codons.

The codon usage shown below in Table 3B is the consensus codon usage table used in the design of the synthetic genes and the final codon usage of the synthetic gene set as constructed below. The actual usage in the synthetic genes reflects design considerations such as DNA and mRNA secondary structure, inclusion and exclusion of restriction sites, and overall GC content.

TABLE 3B

CONSENSUS CODON USAGE

| Amino acid | codon | Design table, %[1] | Synthetic genes, %[1] | Synthetic genes, #[2] |
|---|---|---|---|---|
| arg | cgg | 15 | 15 | 52 |
|  | cga | 0 | 0 | 0 |
|  | cgt | 25 | 26 | 88 |
|  | cgc | 60 | 59 | 200 |
|  | agg | 0 | 0 | 0 |
|  | aga | 0 | 0 | 0 |
| ser | tcg | 30 | 28 | 143 |
|  | tca | 0 | 0.2 | 1 |
|  | tct | 0 | 0.4 | 2 |
|  | tcc | 25 | 26 | 132 |
|  | agt | 0 | 0 | 0 |
|  | agc | 45 | 45 | 225 |
| leu | ctg | 70 | 66 | 481 |
|  | cta | 0 | <0.3 | 2 |
|  | ctt | 0 | <0.2 | 1 |
|  | ctc | 15 | 17 | 125 |
|  | ttg | 15 | 16 | 117 |
|  | tta | 0 | <0.2 | 1 |
| gly | ggg | 20 | 17 | 61 |
|  | gga | 0 | 0 | 0 |
|  | ggt | 30 | 33 | 117 |
|  | ggc | 50 | 50 | 176 |
| val | gtg | 65 | 60 | 245 |
|  | gta | 0 | <0.3 | 1 |
|  | gtt | 0 | 0 | 0 |
|  | gtc | 35 | 40 | 162 |
| ala | gcg | 40 | 38 | 169 |
|  | gca | 20 | 26 | 118 |
|  | gct | 0 | 0 | 0 |
|  | gcc | 40 | 36 | 161 |
| thr | acg | 35 | 39 | 126 |
|  | aca | 0 | 0 | 0 |
|  | act | 0 | 0 | 0 |
|  | acc | 65 | 61 | 200 |
| pro | ccg | 70 | 70 | 194 |
|  | cca | 0 | 0 | 0 |
|  | cct | 0 | 0 | 0 |
|  | ccc | 30 | 30 | 84 |
| ile | ata | 0 | <0.2 | 1 |
|  | att | 30 | 31 | 163 |
|  | atc | 70 | 69 | 365 |
| glu | gag | 40 | 37 | 154 |
|  | gaa | 60 | 63 | 259 |
| asp | gat | 50 | 50 | 186 |
|  | gac | 50 | 50 | 184 |
| lys | aag | 50 | 53 | 240 |
|  | aaa | 50 | 47 | 217 |
| asn | aat | 40 | 41 | 162 |
|  | aac | 60 | 59 | 231 |
| cys | tgt | 20 | 19 | 18 |
|  | tgc | 80 | 81 | 78 |
| tyr | tat | 40 | 42 | 131 |
|  | tac | 60 | 58 | 184 |
| phe | ttt | 34 | 30 | 101 |
|  | ttc | 66 | 70 | 197 |

TABLE 3B-continued

CONSENSUS CODON USAGE

| Amino acid | codon | Design table, %[1] | Synthetic genes, %[1] | Synthetic genes, #[2] |
|---|---|---|---|---|
| gln | cag | 75 | 67 | 171 |
|  | caa | 25 | 33 | 84 |
| his | cat | 50 | 42 | 62 |
|  | cac | 50 | 58 | 86 |
| met | atg | 100 | 100 | 147 |
| trp | tgg | 100 | 100 | 83 |

Figure 6:
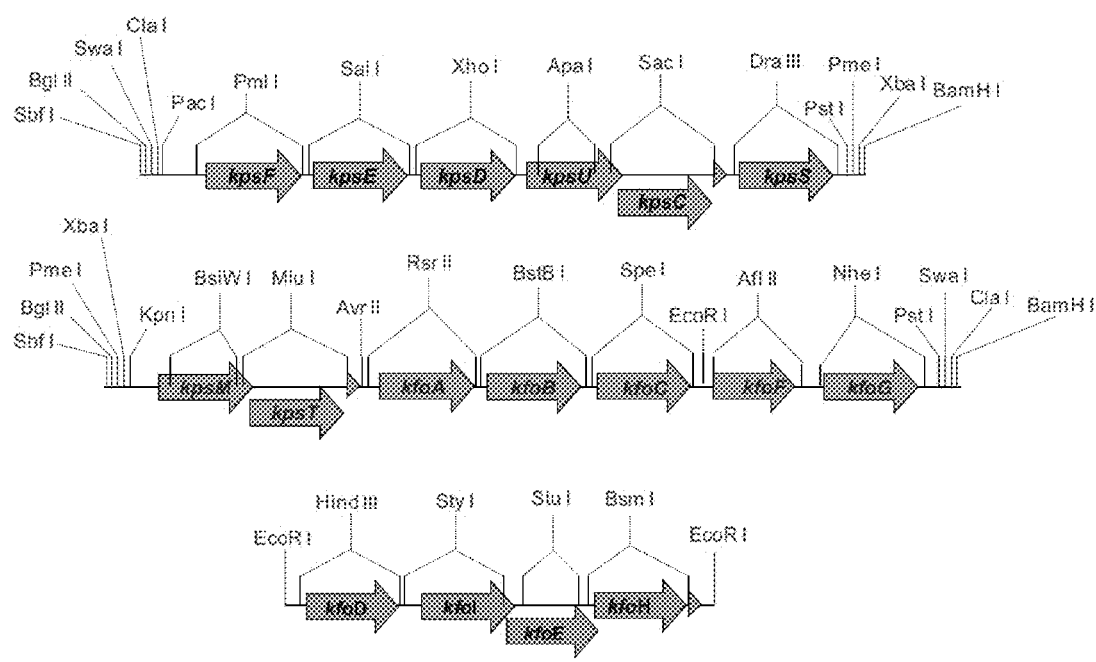
FIG. 6 diagrammatically represents the structure of synthetic genes constructed as three segments, kpsFEDUCS (the "FS segment"), kpsMTkfoABCFG (the "MG segment") and kfoDIEH (the "DH segment"). As depicted, restriction sites were incorporated at strategic locations to allow assembly of the synthetic fragments into one or more operons and to facilitate manipulation of individual genes.

[1] Values are % of total codons for that amino acid
[2] Values are total numbers of codons in synthetic gene set as synthesized A synthetic gene set was constructed as three segments, kpsFEDUCS (the "FS segment"), kpsMTkfoABCFG (the "MG segment") and kfoDIEH (the "DH segment"). FIG. 6 diagrammatically presents the structure of these three synthetic segments. Unique restriction sites, shown in FIG. 6 were incorporated at strategic locations to allow assembly of the synthetic fragments into one or more operons which can be inserted into plasmid expression vectors. The initial strategy was to assemble the genes as a single operon for expression experiments. Other restriction sites also were strategically located throughout the synthetic sequences in positions that allow construction of non-polar deletions for any given gene(s). This can facilitate genetic analysis of the functions of the proteins encoded by the K4 capsule cluster as well as other modifications of the plasmid sequences. A consensus strong ribosome binding site (AGGAGGttaataaATG, SEQ ID NO:46) was employed for most of the synthetic genes; all except for kpsC, kpsT, kfoE, and kfoH. In the *E. coli* K4 U1-41 sequence, the translational start sites of these genes are coupled to the translational stops of the genes immediately upstream and as a result the ribosome binding sites overlap coding sequences of those upstream genes.

The synthetic sequences comprising FS, MG and DH segments as defined above were synthesized as three separate fragments by a commercial vendor, DNA2.0 (Menlo Park, Calif.). The nucleotide sequences of the three synthetic segments are listed as: FS segment (SEQ ID NO:47), MG segment (SEQ ID NO:48) and DH segment (SEQ ID NO:49).

Example 3

Construction of Alternative Host Strains

The initial alternate hosts chosen for expression of the K4 biosynthetic genes included *E. coli* K-12 ("K-12"), *E. coli*. B ("EcB"), *Sphingomonas elodea* ("Sph"), and *Xanthomonas campestris* pv. *campestris* ("Xcc"). K-12 strains W3110 and MG1655 were obtained from the Coli Genetic Stock Center, Yale University. Sph strain ATCC 31461 was obtained from ATCC. Xcc strain NRRL B-1459 (ATCC 13951) was obtained from the ARS Culture Collection (NCUAR), Peoria, Ill. *E. coli* B (ATCC 11303) was obtained from ATCC.

In general, the alternate hosts were prepared for introduction of the K4 genes in two ways. It can be advantageous to be able to deliver genes/plasmids to certain alternate hosts by conjugal transfer from laboratory cloning strains of *E. coli* in tri-parental crosses with *E. coli* containing the mobilizing plasmid pRK2013. To select for transconjugants of the alternate hosts among the conjugal milieu, antibiotic-resistant derivatives (typically streptomycin resistance) of the alternate hosts are required. Alternatively, *E. coli* strain S17-1 (Simon et al., *BioTechnology* 1983; 1:784-791) can be used. This strain has a chromosomally integrated form of plasmid RP4 and will directly mobilize appropriate plasmids to new hosts. This strain is streptomycin resistant, however, so streptomycin cannot be used to select against this strain among the exconjugants.

Figure 7A:
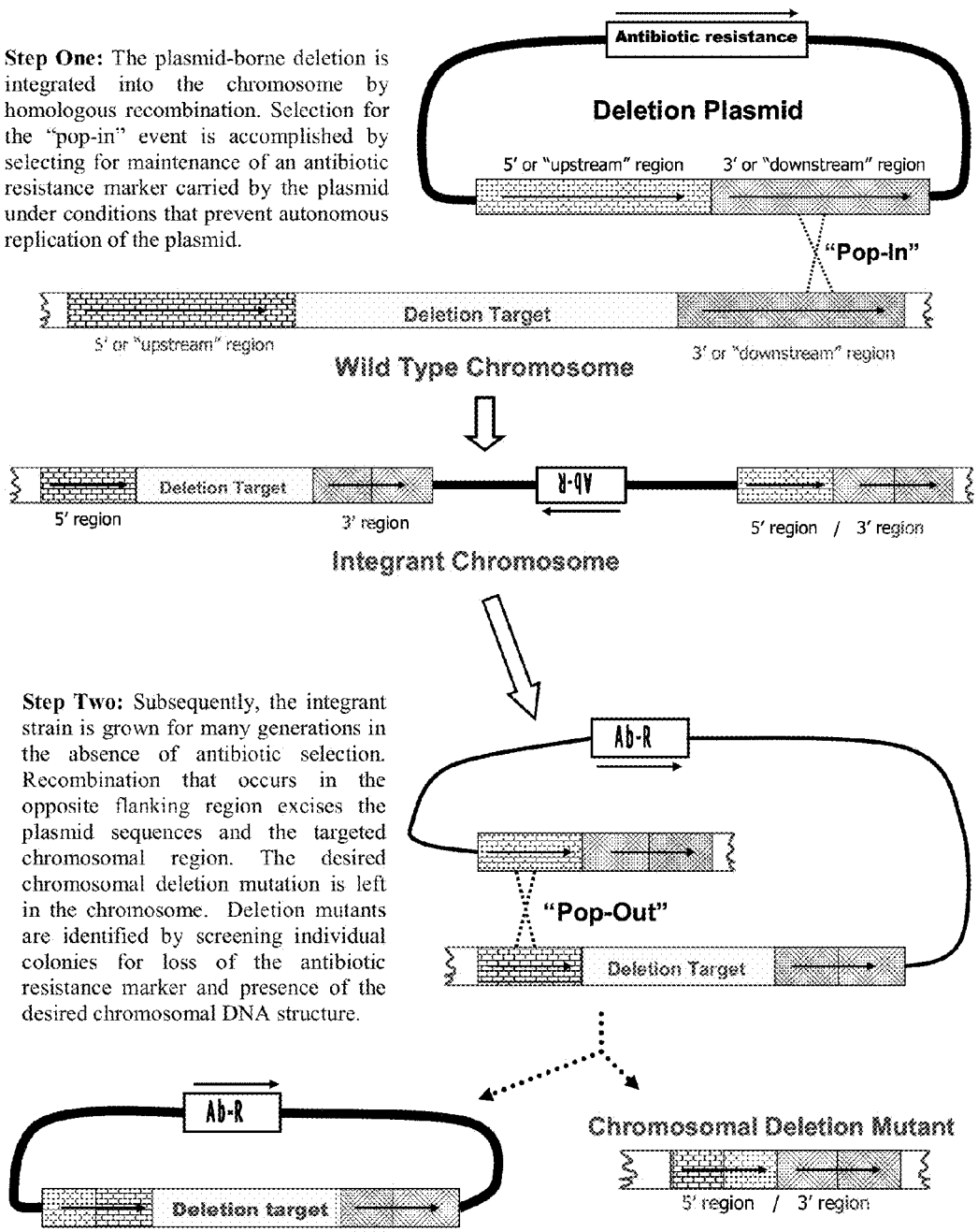
FIG. 7A shows the pop in, pop-out strategy for constructing derivative bacterial strains by deletion of a particular gene or gene cluster.
Figure 7B:
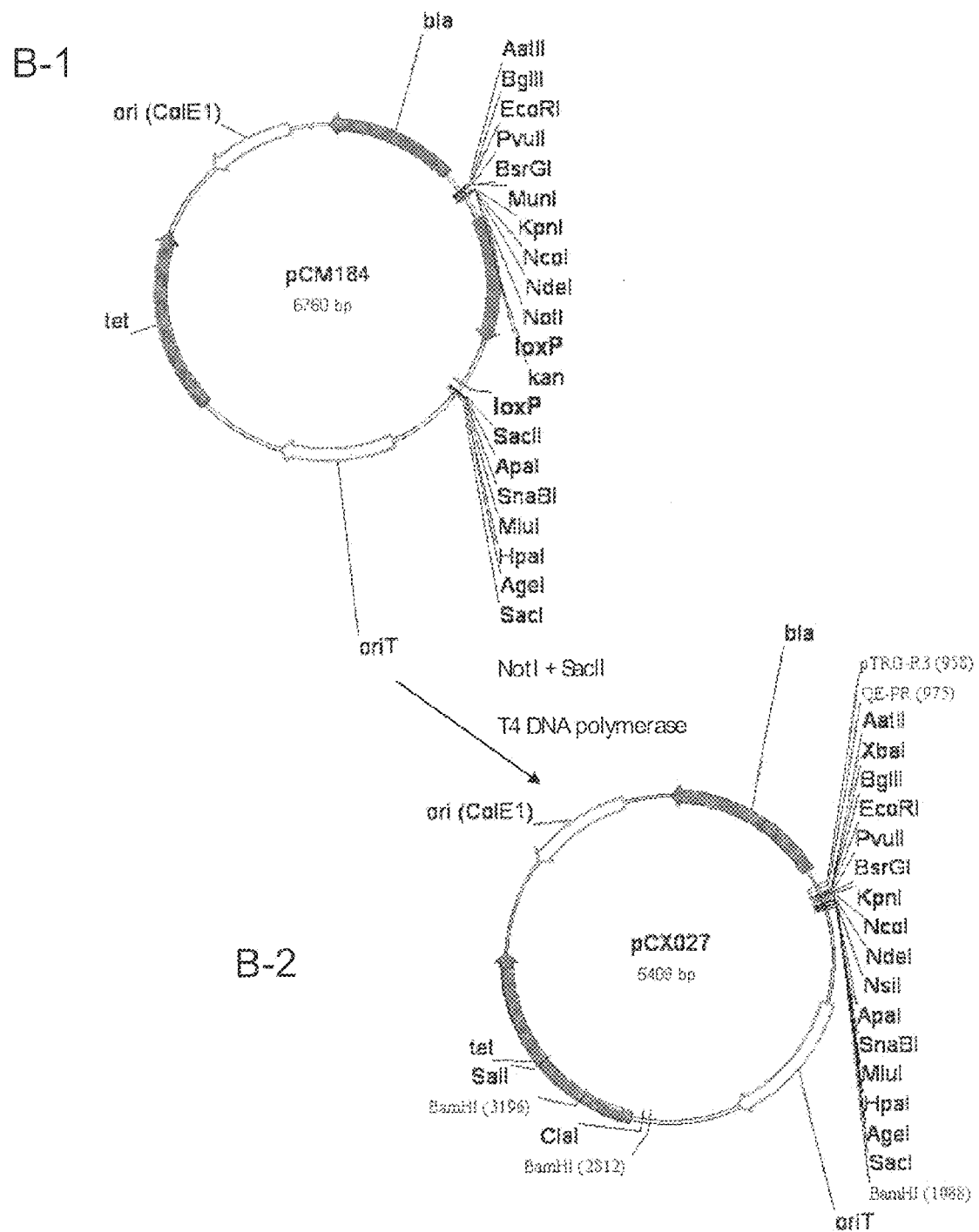
FIG. 7B shows the map of the suicide vector pCX027 (SEQ ID NO:141) used to employ this strategy in *Xanthomonas campestris* in this strategy.

Generation of the gene or gene cluster deletions in Sph, Xcc, and K-12 was carried out using a two-step, "pop-in/pop-out" homology-driven method (See FIG. 7A). In the first step, a plasmid containing a cloned version of the desired deletion structure (homologous regions flanking the deletion) was integrated into the chromosome (popped-in) by recombination in one of the flanking regions (and selection for a marker on the vector) creating duplications of the homologous flanking regions. In the second step, recombination occurred in the opposite flanking region removing (popping-out; "resolving") the cloning vector (plus marker) and the targeted chromosomal region, but leaving the designed deletion. Such strains were obtained by multi-generational growth in the absence of marker selection, followed by screening for loss of the marker and the desired phenotype (determined by colony morphology and/or PCR). For Gram-negative organisms other than *E. coli*, the desired deletion is typically built in a "suicide" vector that can be conjugally transferred to, but cannot replicate in, the target (non-*E. coli*) host strain. For our purposes, we created a "suicide" vector by modifying pCM184 (see FIG. 7B; Marx and Lidstrom, *BioTechniques* 2002; 33(5):1062-1067). The kanamycin-resistance gene and flanking loxP sites were removed by digestion with NotI and SacII, polishing of the ends with T4 DNA polymerase and ligation. The resulting plasmid, pCX027 (SEQ ID NO:141), as shown in FIG. 7B, contained tetracycline-resistance for selection of integrants (in Sph or Xcc) plus a large multi-cloning site. For creating deletions in *E. coli*, plasmid pMAK705 (Hamilton et al., *J. Bacteriol.* 1989; 171 (9):4617-4622) was used. This plasmid contained a temperature-sensitive pSC101 replicon so that production of the first step integration and loss of plasmid sequences in the second ("resolution") step were facilitated at high temperature. The gene structure of "extracellular polysaccharide (EPS) minus" mutants was confirmed by PCR and Southern blot analysis.

The approach to creating deletion constructs was the same for all targets described above. Upstream and downstream regions of homology were derived by PCR using the appropriate genomic DNA as templates. Restriction sites were designed into the PCR primers such that the resulting DNA fragments could be cloned into the desired plasmid, or, as for the Xcc gumD gene described below, restriction sites occurring naturally in the genome were used. The deletions (and the restriction sites used for cloning) were designed such that in-frame fusions were created between short regions of the N-terminal and C-terminal coding regions of the target gene(s). In effect, the targeted coding regions were replaced with a restriction enzyme recognition sequence. The engineered restriction site sequences between the upstream and downstream fragments added 2-3 non-native codons to the fused coding regions. This procedure yielded well-defined mutations with the expectation of little/no polar effects on the expression of downstream genes.

*E. coli* K-12

Colanic acid (M antigen) is an extracellular polysaccharide produced by many enteric bacteria (Grant, W. D., et al., *J. Bacteriol.* 1969; 100:1187-1193), and greater production is typically found at lower growth temperatures (Stout, V., *J. Bacteriol.* 1996; 178:4273-4280). The creation of *E. coli* K-12 strains defective in the colanic acid biosynthesis is described in this Example. Such strains do not produce interfering or contaminating colonic acid when they are further engineered for the production of recombinant chondroitin which can be carried out at 30° C. or lower. Plasmid pMAK705 (Hamilton, C. M., et al., *J. Bacteriol.* 1989; 171: 4617-4622) was used to create precise deletions in the chromosomal colonic acid biosynthetic gene cluster. This plasmid contains a temperature sensitive replicon and cannot exist in an extra-chromosomal state at higher temperatures. In general, the steps for creating precise mutations at a target locus result from a "pop-in/pop-out" mechanism and are described by Hamilton et al. (supra.). Plasmid clones containing the designed mutations are driven into the chromosome ("pop-in"), typically via homologous recombination at the target locus, by growth of transformants at the non-permissive temperature and selection for plasmid-encoded antibiotic (chloramphenicol; Cm) resistance. Subsequent multi-generational growth of these integrants in the absence of chloramphenicol results in a sub-population of cells in which the plasmid has recombined out of the chromosome and been lost from the cell during cell division leaving behind either the original wild type structure or the mutant structure. These "pop-outs" are identified by Cm sensitivity. A strain with the desired mutant structure is then identified by phenotype (if possible) and by PCR or Southern blotting.

The colonic acid biosynthetic operon in *E. coli* K-12 consists of 19 or 20 contiguous genes covering about 24 kb (Stevenson, G., et al., *J. Bacteriol.* 1996; 178:4885-4893). The twentieth gene, wcaM, appears to be part of the operon/transcription unit but is not required for colonic acid production. Contained therein is the wcaJ gene encoding the glycosyltransferase enzyme responsible for loading of the first sugar onto a lipid carrier during colonic acid biosynthesis. This Example describes the creation of *E. coli* K-12 strains containing deletions of either the entire 20-gene operon or just the wcaJ gene. The sequence of the genome of *E. coli* K-12 strain W3110 is published as GenBank AP009048 (Blattner, F. R., et al., *Science* 1997; 277:1453-1462).

Deletion of the colonic acid operon: PCR primers were designed to amplify approximately 950 bp upstream of the first gene (wza) and downstream of the last gene (wcaM) of the W3110 colonic acid operon. These fragments provided homology to the desired recombination sites in the chromosome. The PCR primers were designed to result in non-native restriction sites at the ends of the amplified PCR products to be used in subsequent cloning. The upstream region was amplified with primers CAX129 (HindIII site underlined) and CAX128 (AscI site underlined). The downstream region was amplified with primers CAX130 (AscI site underlined) and CAX131 (XbaI site underlined).

```
CAX128
                                      (SEQ ID NO: 50)
GGCGCGCCAGCGTCCTGCTGTTTGATGACG

CAX129
                                      (SEQ ID NO: 51)
AAGCTTGCCAGGAGATTGACGCCAGC

CAX130
                                      (SEQ ID NO: 52)
GGCGCGCCGGAATCCTCAGTTGGACCCGC

CAX131
                                      (SEQ ID NO: 53)
TCTAGAACTTTACCCTCACGGTCCAGCG
```

PCR was performed with Pfu polymerase (Stratagene) for 30 cycles of denaturation at 95° C., annealing at 57° C. and extension at 72° C. (20 sec. each step). The template consisted of 100 ng of *E. coli* K-12 W3110 genomic DNA. The PCR fragments were cloned into pCR-Blunt II-TOPO (Invitrogen) and transformed into *E. coli* TOP10 (Invitrogen), and the sequences of selected cloned inserts were confirmed to match published data. An upstream clone was digested with HindIII plus AscI, and a downstream clone was digested with XbaI plus AscI. The desired fragments were gel-purified (Gene Clean Turbo, Q-BIOgene) and ligated with pMAK705 that had been digested with HindIII plus XbaI followed by treatment with Antarctic phosphatase (New England Biolabs). Cm-resistant (LB Cm 34 µg/mL, 30° C.) transformants of *E. coli* DH5α (Invitrogen) were analyzed for plasmid structure, and one with the desired structure was named pMAK-CL. In this plasmid (and the chromosomal deletion ultimately derived from it), the union of the upstream and downstream fragments at the AscI site resulted in a small 345 bp open reading frame consisting of the 5' end of the wza gene and the 3' end of the wcaM gene. This feature was designed to minimize disruption of potential expression from the colonic acid operon promoter of any genes farther downstream of wcaM.

Plasmid pMAK-CL was transformed into *E. coli* W3110 by electroporation with selection for Cm resistance by plating on LB (Maniatis, 1989) agar plates containing Cm at 17 µg/mL at 30° C. (permissive temperature). Several transform colonies were streaked to M9 (Maniatis, 1989) Cm 17 µg/mL agar plates and incubated at 43° C. (non-permissive temperature). After two days, multiple colonies (presumptive integrants) were present, and these were re-streaked to M9 Cm at 43° C. for confirmation. Two presumptive integrants were grown for about 25 generations in LB medium at 37° C., and dilutions were prepared and spread to LB plates for growth at room temperature (22-24° C.). After three days, colonies were transferred to two LB agar plates, one containing Cm 17 µg/mL, for growth at 30° C. Cm-sensitive isolates were present at frequencies of 62% and 94% among derivatives of the two original integrants. These presumably resulted from "pop-out" and loss of the pMAK-CL plasmid. "Colony PCR" was used to evaluate the structure at the colonic acid operon in these strains. A small amount of a colony was suspended in 10 µL of sterile de-ionized water in a tube compatible with PCR. To this was added 20 µL of a 1.5-fold concentrated mix of "Taq Master" (Eppendorf) components such that the final concentrations/amounts in the reaction were: 1× Taq polymerase buffer, 1× "Taq Master" reagent, 0.33 mM each dNTP, 0.4 µM each primer, and 0.5 units Taq polymerase. PCR was started with 8 minutes at 95° C., continued with 35 cycles of denaturation at 95° C. for 30 sec., annealing at 55° C. for 30 sec., and extension at 68° C. for 3 min., and finished with extension at 68° C. for 7 min. Initial characterization was carried out with a forward primer (CAX132) in the upstream homologous region and a reverse primer (CAX135) in the downstream homologous region.

```
CAX132
                                      (SEQ ID NO: 54)
CCGAATTGTTATCTTGCCTGC

CAX135
                                      (SEQ ID NO: 55)
GGTAGCATCTCTTTGGGTATCG
```

PCR of strains containing the desired operon deletion were expected to produce a 1000 bp fragment, and this was found in 9 of 23 "pop-out" strains analyzed. To ensure that undesired rearrangements had not occurred in these strains, "colony PCR" with primers outside of the regions of homology were used: CAX162 (forward) and CAX163 (reverse).

CAX162

GAACAGCGGTTGAGTCAGGG (SEQ ID NO:56)

CAX163

GGCAGAAAGCACATAGCGACC (SEQ ID NO:57)

These outside primers gave a PCR product of 2065 bp in deletions of the desired structure, and 4 of the 9 strains produced this PCR product; one of these was designated MSC188. Further confirmation of the structure of the deletion in strain MSC188 was achieved by Southern blotting. A "DIG"-labeled probe (Roche) was generated with primers CAX128 and CAX129 (1000 bp) using pMAK-CL as template. Chromosomal DNA from wild type E. coli W3110 and MSC188 was digested with restriction enzymes KpnI, PstI and BglII, and the digests were subjected to gel electrophoresis and blotting. Probing revealed the expected band patterns in MSC188 and W3110, respectively: KpnI, 5921 bp vs. 9431 bp; PstI, 3902 bp vs. 12893 bp, and BglII, 9361 bp vs. 6201 bp.

Deletion of wcaJ: The strategy for deletion of the wcaJ gene in E. coli K-12 W3110 followed that described above for deletion of the entire colanic acid biosynthetic operon. PCR primers were designed to amplify approximately 500 bp upstream and downstream of the wcaJ gene of the W3110 colanic acid operon. The upstream region was amplified with primers CAX126 (HindIII site underlined) and CAX125 (PacI site underlined). The downstream region was amplified with primers CAX124 (PacI site underlined) and CAX127 (XbaI site underlined).

CAX124

TTAATTAACAAAGGTTTCGTTAACAAAGCGG (SEQ ID NO: 58)

CAX125

TTAATTAAATTGGTTTTCGCTCGCTCGC (SEQ ID NO: 59)

CAX126

AAGCTTGGAAGACGCCATCTATGGTGG (SEQ ID NO: 60)

CAX127

TCTAGAGAAGCCCGCCAGCACCGC (SEQ ID NO: 61)

Restriction fragments of the upstream and downstream PCR products were cloned into pMAK705 to yield pMAK-wca. In this plasmid and the chromosomal deletion ultimately derived from it, the union of the upstream and downstream fragments at the PacI site resulted in a small 75 bp open reading frame consisting of the 5' and 3' ends of the wcaJ gene. This feature was designed to allow un-interrupted expression of all other operon genes in the event that they benefit production of chondroitin. Initial characterization of presumptive wcaJ deletion derivatives of E. coli W3110 by colony PCR was carried out with primers CAX126 and CAX127, and 11 of 23 prospective "pop-outs" gave the desired signal. Outside primers CAX160 (forward) and CAX161 (reverse) were used to identify presumptive wcaJ deletions, and 3 of 4 strains tested contained the expected product (1188 bp). One strain with the desired DNA structure was designated MSC175.

CAX160

CCGTTGATGTGGTGACTGCC (SEQ ID NO: 62)

CAX161

AAACAGCAGCGTTCTCACCG (SEQ ID NO: 63)

For Southern blot confirmation, the "DIG"-labeled probe was generated with primers CAX124 and CAX127 (514 bp) using pMAK-wca as template. Chromosomal DNA from wild type E. coli W3110 and MSC175 was digested with restriction enzymes PacI, DraIII and NdeI, and the digests were subjected to gel electrophoresis and blotting. Probing revealed the expected band patterns in MSC175 and W3110, respectively: PacI, 8456 bp vs. >28000 bp; DraIII, 4502 bp vs. 5819 bp, and NdeI, 8512 bp vs. 9829 bp.

Xanthomonas campestris

Xanthomonas campestris pv. campestris (Xcc) is used commercially to produce the extracellular carbohydrate polymer xanthan gum for a variety of industrial and food applications (Baird, J., et al., BioTechnology 1983; 1:778-783). In order to employ this strain and process for production of chondroitin, Xcc strains unable to biosynthesize xanthan gum are required. A strategy similar to that used (above) for E. coli was used to delete the entire xanthan gum biosynthetic operon or just the gene for the first glycosyltransferase, gumD, in Xanthomonas campestris pv. campestris strain ATCC13951, also known as NRRL B-1459 (Capage, M. R. et al., World Patent WO87/05938; Katzen, F., et al., J. Bacteriol. 1998; 180(7):1607-1617). First, a spontaneously-arising derivative resistant to 100 µg/mL streptomycin sulfate in nutrient agar at 30° C. was obtained and named MSC116. PCR primers were designed against the sequence of the xanthan gum biosynthetic cluster of strain NRRL B-1459 (GenBank accession #U22511) and, where necessary, to the genomic sequence for X. campestris pv. campestris ATCC33913 (GenBank accession AE008922).

Deletion of gumD: The strategy for deletion of the gumD gene takes advantage of naturally occurring EcoRI restriction sites approximately 1650 bp upstream (5') and 1000 bp downstream (3') of the coding region. PCR primers were designed outside of these restriction sites, and these were paired with PCR primers targeting regions just inside of the gumD coding sequence to generate upstream and downstream regions of homology. To amplify approximately 1800 bp of upstream homology, primers CAX114 and CAX116 were used. To amplify approximately 1100 bp of downstream homology, primers CAX115 and CAX117 were used. The two middle primers in the ends of the gumD coding region were amended with SbfI restriction sites (underlined below).

CAX114

CCTGCAGGGTCGAACACTCGCAAGACCAGG (SEQ ID NO: 64)

CAX115

CCTGCAGGTATCCGCATCATCGTGCTGACG (SEQ ID NO: 65)

CAX116

CCTTGGTGATGGTGTGGCG (SEQ ID NO: 66)

CAX117

GCCCATCCACGACTCGAACG (SEQ ID NO: 67)

PCR was performed with Pfu Ultra II polymerase (Stratagene) for 30 cycles of denaturation at 95° C. (20 sec.), annealing at 62° C. (20 sec.) and extension at 72° C. (30 sec.). Template consisted of 100 ng of *X. campestris* pv. *campestris* (strain ATCC13951; "Xcc") genomic DNA. The PCR fragments were cloned into pCR-Blunt II-TOPO (Invitrogen) and transformed into *E. coli* TOP10 (Invitrogen). The relevant sequence of an upstream homology clone matched the sequence of the PCR product, but this shared sequence differs by two base pairs from the published Xcc sequence for this region (primers excluded). It is likely that the published sequence contains a small number of incorrect assignments. The relevant sequence of a downstream homology clone matched the sequence of its PCR product and that of the published Xcc sequence for this region (primers excluded).

The strategy for creating specific gene deletions using a "pop-in/pop-out" mechanism in *Xanthomonas* was based on a derivative of plasmid pCM184 (Marx, C. J., and Lidstrom, M. E., BioTechniques 33(5):1062-1067, 2002). Plasmid pCM184 consisted of a ColE1 replicon, which permits replication of the plasmid in *E. coli* but not in *Xanthomonas* (or other non-enteric bacteria), an oriT region for conjugal transfer among Gram negative bacteria, resistance genes for ampicillin and tetracycline, plus a resistance gene for kanamycin ($Kan^r$) flanked by loxP sequences. This plasmid was designed to create unmarked (no remaining antibiotic resistance gene) deletions in non-*E. coli* strains, but the described procedure left the small loxP sequence at the site of the deletion. However, it was desirable for the strains created in the present invention to contain no unnecessary sequences such as loxP. Therefore, pCM184 was modified to remove the loxP sites and the intervening kanamycin resistance gene. This allowed for use of the resulting derivative plasmid for creation of desired unmarked deletions in *Xanthomonas* by a variation on the "pop-in/pop-out" mechanism described above.

About 1.8 μg of plasmid pCM184 was digested with NotI plus SacII restriction enzymes (chosen to remove the loxP/$Kan^r$/loxP region but leave most restriction sites for future use), and the completed reaction was heated to 75° C. for 15 min. to inactivate the enzymes. The sample (20 μL) was then treated with T4 DNA polymerase (1.8 U, New England Biolabs) plus 100 μM each dNTP for 15 min. at 12° C. to fill-in the single strand overhang from NotI digestion and to trim back the overhang from SacII digestion (i.e., create blunt ends). Reaction was terminated by the addition of EDTA to 10 mM and heating at 75° C. for 20 min. About 170 μg of treated plasmid was reacted with 400 U T4 DNA ligase (New England Biolabs) in a 10 μL volume at 16° C. for 4 hrs. The ligation reaction was subsequently treated with 2.5 U SbfI for 90 min to digest unwanted DNA structures (such as reformed pCM184). A 0.5 μL volume of this reaction was used to transform *E. coli* TOP10 (Invitrogen), and plating to LB $Tc^5$ resulted in numerous colonies after overnight incubation at 37° C. The plasmid contained in cells from a chosen colony was shown by restriction enzyme analysis and DNA sequencing to be of the desired structure: this plasmid was named pCX027 (SEQ ID NO:141) and is diagrammed in FIG. 7B.

The plasmids (about 2 μg each) containing the cloned PCR products for the gumD upstream and downstream regions (above) were digested with 10 U SbfI for 2 hr at 37° C., then 10 U EcoRI (with enzyme-specific buffer) under the same conditions. After heat treatment (70° C. for 20 min.), the digests were subjected to agarose gel electrophoresis, and the desired fragments (upstream fragment about 1.6 kb; downstream fragment about 1.1 kb) were purified with the QIAGEN Mini-Elute kit. Plasmid pCX027 (about 3.5 μg) was digested with 20 U EcoRI in a 50 μL reaction for 2.5 hr at 37° C., treated with about 18 U Antarctic phosphatase (New England Biolabs) in a 60 μL reaction for 15 min. at 37° C., and then heated at 70° C. for 20 min. A three-way ligation was carried out with about 100 ng each of treated pCX027 and purified gumD upstream and downstream fragments in 10 μL reactions at 16° C. for about 20 hr. Half of this reaction was transformed into *E. coli* DH5α (Stratagene) followed by plating to either LB $Ap^{100}$ or LB $Tc^5$ at 37° C. Colony PCR was performed (as described above) to identify clones with the desired structure using primers CAX122 and CAX119 homologous to regions in the upstream and downstream sequences, respectively.

```
CAX119
                                    (SEQ ID NO: 68)
GACCAATGACACGATGATCG

CAX122
                                    (SEQ ID NO: 69)
GCATCCGCTACAACATGCTC
```

PCR products of the expected size (1169 bp) were detected in several colonies, and the desired structures were confirmed by restriction analysis. Plasmids in which the orientation (given as the gum gene reading frames) of the paired homology regions were the same or opposite of that for the vector $Tet^r$ gene were named pCX030 and pCX031, respectively.

*Xanthomonas campestris* pv. *campestris* ("Xcc"; B-1459 from the ARS Culture Collection (NCUAR), Peoria, Ill.; also known as ATCC13951) was grown in nutrient broth (NB, Difco) overnight at 30° C. (all growth of Xcc strains at 30° C. unless indicated), diluted 1:5 in fresh NB, and 100 μL aliquots were spread to nutrient agar (NA, Difco) plates containing streptomycin (str) at 100 μg/mL followed by incubation at 30° C. After several days, colonies were detected at a frequency of about 1 per $10^7$ originally-plated cells. Several spontaneously-arising streptomycin-resistant Xcc strains were purified by streaking to NA $str^{50}$ plates, and one such isolate was named MSC116.

Plasmid pCX030 or pCX031 was transferred to Xcc strain MSC116 by electroporation (Oshiro et al., J. Microbiol. Method 2006; 65:171-179). Tetracycline-resistant colonies ($Tc^R$) were obtained from transformants from pCX030 ($4.1\times10^4$/μg) and pCX031 ($3.1\times10^4$ μg), respectively. Genomic DNA was prepared from isolated $Tc^R$ strains derived from pCX031 transformation and evaluated by PCR for the site of pCX031 integration. Primer pairs were chosen to determine linkage of genomic sequence outside of the upstream region used in pCX031 to the downstream region and sequence outside of the downstream region used in pCX031 to the upstream region. Specifically, primer CAX116 ("outside primer" for upstream region) plus CAX119 (in downstream homologous region; see above) were used to test the upstream linkage and CAX117 ("outside primer" for downstream region; see above) plus CAX122 (in upstream homologous region; see above) were used to test the downstream linkage. PCR was conducted with Go Taq DNA polymerase (Promega, Madison, Wis.) with 0.5 μM each primer, 250 μM each dNTP, 1000 ng DNA template, and 0.5 U enzyme. Reaction conditions include initial denaturation at 94° C. for 4 min., 30 cycles of 15 sec. denaturation at 94° C., 30 sec. annealing at 55° C., and 4 min. extension at 72° C. and final extension for 2 min. "Pop-in" isolates were identified for both upstream and downstream integration of pCX031. Two isolated "pop-in" strains were designated MSC221 and MSC222. These strains were inoculated in LBLS (10 g/L Bacto peptone, 5 g/L NaCl, 5 g/L yeast extract, no antibiotics) for growth at 30° C., and then thrice sub-cultured into the same medium at 48 hr intervals using 1:1000 dilutions. The resulting cultures were diluted, and aliquots were spread to NA $Str^{50}$ plates. Resulting colonies were transferred to NA and NA $Tc^5$ plates. $Tc^S$ strains were found at a frequency of 2% from both strains. Colony PCR analysis against selected $Tc^S$ strains using the primer pairs (CAX116 plus CAX119 and CAX117 plus CAX122), as described above, demonstrated that all strains tested were consistent with gumD deletion. These isolated "pop-out" strains from MSC221 and MSC222 were designated MSC225 and MSC226, respectively. Colonies of MSC225 and MSC226 on agar plates were clearly non-mucoid relative to colonies of the MSC116 parent strain.

Deletion of the xanthan gum biosynthetic gene cluster: Deletion of the gumB thru gumM biosynthetic cluster largely follows the same steps detailed for deletion of the gumD gene. Regions of homology upstream of gumB and downstream of gumM were created by PCR with primers CAX136×CAX137 (1434 bp) and CAX138×CAX139 (1420 bp), respectively, incorporating a BglII restriction site for cloning into pCX027 and NotI sites for fusion between the upstream and downstream fragments. Fusion of the NotI sites will create an open reading frame for a 53 amino acid polypeptide consisting of the 5' end of the gumB and 3' end of the gumM coding sequences. Restriction sites are underlined: BglII in CAX136 and CAX139; NotI in CAX137 and CAX138.

```
CAX136
                                (SEQ ID NO: 70)
AGATCTGGCGGTAACAGGGGATTGGC

CAX137
                                (SEQ ID NO: 71)
GCGGCCGCCAAGACGGTATTCGGGCTGC

CAX138
                                (SEQ ID NO: 72)
GCGGCCGCGATCTGCTGGTGTTCTTCCGC

CAX139
                                (SEQ ID NO: 73)
AGATCTCCTACCGACCAGGCATTGGC
```

PCR was performed with Pfu Ultra II polymerase (Stratagene) for amplification of upstream and downstream fragments. Reaction conditions include initial denaturation at 94° C. for 4 min., 30 cycles of 20 sec. denaturation at 95° C., 30 sec. annealing at 57° C., 30 min. extension at 72° C. and final extension at 72° C. for 5 min. Template consisted of 100 ng of *X. campestris* pv. *campestris* (strain ATCC13951; "Xcc") genomic DNA. The PCR fragments were cloned into pCR-Blunt II-TOPO (Invitrogen) and transformed into *E. coli* TOP10 (Invitrogen). The relevant sequence of an upstream homology clone matches the sequence of the PCR product, but this shared sequence differs by 14 base pairs from the published sequence of Xcc strain ATCC33913 for this region (primers excluded). These sequence variances likely reflect subtle differences between the B-1459/ATCC13951 and ATCC33913 genomes. The relevant sequence of a downstream homology clone matches the sequence of the PCR product and this sequence does not differ from the published Xcc ATCC33913 sequence for this region (primers excluded). The plasmids (about 1 μg each) containing the cloned PCR products for the upstream region of gumB (above) and the downstream region of gumM (above) were digested with 7.5 U NotI and 7.5 U BglII for 2 hr at 37° C. The digests were subjected to agarose gel electrophoresis, and the desired fragments (each about 1.4 kb) were purified with the QIAGEN Mini-Elute Kit. Plasmid pCX027 (about 1.0 μg) was digested with 15 U BglII in a 15 μL reaction for 2 hr at 37° C., treated with about 5 U Antarctic phosphatase (New England Biolabs) in a 75 μL reaction for 15 min. at 37°, and then heated at 65° C. for 10 min. After purification of BglII digested pCX027, a three-way ligation was carried out with purified pCX027, the upstream fragment of gumB, and the downstream fragment of gumM in 20 μL reactions at room temperature for 3 hr. Half of the reaction mixture was transformed into *E. coli* TOP10 (Invitrogen) followed by plating to either LB $Ap^{100}$ or LB $Tc^5$ at 37° C. Colony PCR was performed (as described above) to identify clones with the desired structure using CAX140 (in upstream homologous region) and CAX145 (in downstream homologous region).

```
CAX140
                                (SEQ ID NO: 74)
CCGAATTTCCGAGCCTGG

CAX145
                                (SEQ ID NO: 75)
GCCCGCTCGCTTCGTCG
```

Plasmid was prepared from PCR positive clones with the QIAGEN Qiaprep Spin Miniprep Kit and digested with BglII, NdeI or NcoI to confirm the structure of the plasmid including its orientation of homologous regions in the upstream and downstream sequences. Plasmids in which the orientations of the paired homology regions were the same or opposite of that for the vector $Tet^r$ gene were designated pKM001 and pKM002, respectively.

Plasmid pKM001 or pKM002 was transferred to Xcc strain MSC116 by electroporation (Oshiro et al., *J. Microbiol. Method* 2006; 65:171-179). $Tc^R$ colonies were obtained from transformants of pKM001 ($5.3\times10^3$/μg) and pKM002 ($5.0\times10^3$/μg), respectively. Genomic DNA was prepared from isolated $Tc^R$ strain derived from pKM001 transformant and evaluated by PCR for the site of pKM001 integration. Primer pairs were chosen to determine linkage of genomic sequence outside of the upstream region used in pKM001 to the downstream region and sequence outside of the downstream region used in pKM001 to the upstream region. Specifically, primer prKM001 ("outside primer" for upstream region; see below) plus CAX145 (in downstream homologous region; see above) were used to test the upstream linkage and prKM002 ("outside primer" for downstream region; see below) plus CAX142 (in upstream homologous region; see below) were used to test the downstream linkage.

```
prKM001
                                (SEQ ID NO: 76)
ACGTGGATGCGGTCGTCGC
prKM003
                                (SEQ ID NO: 77)
GGGGCTTGCGGGTCGGC

CAX142
                                (SEQ ID NO: 78)
CGTATGCTGAGAATGACGACC
```

PCR was conducted with Go Taq DNA polymerase (Promega) with 0.5 μM each primer, 250 μM each dNTP, 600-1000 ng DNA template, and 0.5 U enzyme. Reaction conditions include initial denaturation at 94° C. for 5 min., 30 cycles of 15 sec. denaturation at 94° C., 30 sec. annealing at 55° C., and 4 min. extension at 72° C. and final extension for 2 min. "Pop-in" isolates were identified for upstream integration of pKM001. These isolated strains were designated MSC242, MSC247 and MSC248.

MSC242, MSC247 and MSC248 were inoculated in LBLS medium for growth at 30° C., and then thrice sub-cultured into the same medium at 48 hr intervals using 1:1000 dilutions. The resulting cultures were diluted, and aliquots were spread to NA Str$^{50}$ plates. Resulting colonies were transferred to NA and NA Tc$^5$ plates. Tc$^S$ strains were observed at frequencies of 1-2% from the three strains. Genomic structure in selected Tc$^S$ strains was evaluated by PCR to confirm deletion of xanthan gum synthesis genes from gumB to gumM using prKM001 plus CAX145 for upstream linkage and prKM003 plus CAX142 for downstream linkage (see above). PCR was conducted with Herculase II Fusion DNA polymerase (Stratagene) with 0.25 µM each primer, 250 µM each dNTP, 500-700 ng DNA template, and 0.5 U enzyme. Reaction conditions included initial denaturation at 98° C. for 4 min., 30 cycles of 20 sec denaturation at 98° C., 20 sec. annealing at 60° C., and 2 min. extension at 72° C. and final extension for 4 min. Three "pop-out" strains (one from each "pop-in" strain) showed the PCR products consistent with deletion of the xanthan gum biosynthetic gene cluster. These xanthan gum biosynthesis gene deletion "pop-out" strains from MSC242, MSC247 and MSC248 were designated MSC255, MSC256 and MSC257, respectively. Colonies of MSC255, MSC256, and MSC257 on agar plates were clearly non-mucoid relative to colonies of the MSC116 parent strain.
E. coli B The genome of E. coli BL21 (DE3), a derivative of wild type E. coli B (ATCC11303), was reported to contain an inactive group 2 capsule gene cluster in which the regions 1 and 3 were intact (and functional), but region 2 was disrupted and non-functional (Andreishcheva, E. N., and Vann, W. F., Gene 2006; 384:113-119). Given that genes of regions 2 were polymer-specific but that regions 1 and 3 were generic and less specific, E. coli B can be engineered to synthesize chondroitin by providing just the K4 region 2 genes on a plasmid or integrated into the chromosome (see below). To improve the utility of E. coli B as a host for chondroitin production, the production of colanic acid was eliminated by genetic mutation as described for E. coli K-12 above.

Deletion of the colanic acid operon: The process for deletion of the E. coli B colanic acid operon follows that used for the K-12 strain described above. At the time of this invention, the E. coli B genome sequence was not publicly available. Though the K-12 and B strains are closely related, some differences in DNA sequences are expected. Therefore, creation of new upstream and downstream homologous regions was needed, and the existing primers used for strain K-12 were employed. Specifically, PCR with primers pairs CAX128×CAX129 and CAX130×CAX131 and E. coli B genomic DNA template was used to generate upstream and downstream homologous regions, respectively. Products of about 1 kb in size were obtained, cloned, and sequenced. In the non-primer sequences, the upstream homologous region (944 bp) differs by only two bases (transitions) from the K-12 upstream region, and the downstream homologous regions (911 bp) differs by 30 bases (24 transitions, 6 transversions). The upstream and downstream fragments were cloned into pMAK705 to generate pMAK-BCL.

Plasmid pMAK-BCL was introduced into E. coli B by electroporation. LB medium was inoculated with a fresh colony and incubated overnight at 37° C. with vigorous shaking. A volume of fresh, pre-warmed LB was inoculated with the overnight culture to give an initial OD600 reading of 0.03 (BioPhotometer, Eppendorf). The culture was grown to OD600≈0.8 and then chilled on ice for 30-40 minutes. Cells were collected by centrifugation (10 min., 4000 g), and the cells were washed twice by re-suspension in original volumes of ice-cold deionized water followed by re-centrifugation. The cells from the final centrifugation were suspended in ⅟₅₀₀$^{th}$ volume of ice-cold water. pMAK-BCL (200 ng) was added to 50 µL of prepared E. coli B suspension and incubated on ice for about 20 min. Electroporation was carried out with Gene Pulser Xcell (BioRad) in 0.1 mm gap cuvettes at settings of 25 µF, 200Ω, and 1.8 kV yielding durations of 4.5-5.0 msec. Pulsed cells were diluted with 350 µL SOC medium (Maniatis, 1989) and incubated at 37° C. for 1 hr; 5-10 µL was then spread to LB Cm$^{34}$ agar plates with incubation at 43° C. Colonies appearing after 2 days (representing "pop-in" candidates) were streaked to LB Cm$^{34}$ agar plates at 43° C., and resulting colonies were inoculated into LB medium (no Cm) for growth and serial passage at 30° C. Colonies derived from these cultures were tested for Cm-sensitivity, and "pop-out" candidates were identified. Colony PCR was used to characterize the candidate strains. One isolate was found to give the expected PCR products using primer pairs CAX129×CAX132, CAX131×CAX132, CAX132×CAX135, CAX129×CAX135, and CAX162×CAX163. This E. coli β isolate deleted for the colanic acid gene cluster was named MSC364.

Example 4

Construction of Expression Vectors

Well characterized high-copy-number and low-copy-number plasmid vectors specific to E. coli have been described (Balbas and Bolivar, Methods Enzymol. 1990; 185:14-37, Das, Methods Enzymol. 1990; 182:93-112, Mardanov et al. Gene 2007; 15(395):15-21). Such vectors employ a variety of well characterized promoter systems for regulated gene expression in E. coli. Additionally, conjugally-transmissible plasmid vectors based on broad host range plasmids such as RK2 (low copy number IncP) and RSF1010 (high copy number IncQ) that function in E. coli, X. campestris and a wide variety of other gram negative bacteria are also available (Franklin and Spooner, Promiscuous plasmids in Gram-negative bacteria Academic Press (London) 1989 pp 247-267, Mather et al. Gene 1995; 15:85-88, Haugen et al., Plasmid 1995; 33:27-39. Mermod et al., J Bact. 1986; 167:447-454). The synthetic chondroitin biosynthetic gene set can be cloned into these versatile broad host range vectors so that the same plasmids can be used for gene transfer and expression in a wide array of gram-negative bacteria including X. campestris, S. elodea, P. putida, and non-pathogenic E. coli (Guiney and Lanka, Promiscuous plasmids in Gram-negative bacteria Academic Press (London) 1989 pp 27-54).

Many useful IncP-based vectors are derived from the RK2, a conjugally self-transmissible plasmid originally isolated from clinical Pseudomonas isolates and subsequently shown to be capable of transferring itself into, and functioning within, nearly every gram negative bacterium tested. Smaller derivatives of RK2 have been constructed that are stable replicons and can be conjugally transferred when "helper" functions are supplied in trans from a second plasmid. One such plasmid is pFF1 (Durland et al., J. Bact. 1990; 172:3859-3867). Some useful derivatives of this plasmid have been described; one of these is pJB653 (Blatny et al., Appl. Enviorn. Micro. 1997; 63:370-379) which adds the Pm promoter of the Pseudomonas TOL plasmid and the regulatory gene xylS to provide a strong, well regulated promoter shown to function in a variety of gram negative bacteria. This vector and related constructs are the subject of U.S. Pat. No. 6,258, 565. Various IncQ-based plasmid vectors have been derived from RSF1010, an 8.7 kb plasmid originally isolated from Pseudomonas putida. RSF1010 can propagate in E. coli and a wide variety of gram negative bacteria. Derivatives of RSF1010 carrying the Pm promoter and xylS regulatory protein have been constructed and described. The plasmid pNM185 (Mermod et al., *J. Bact.* 1986; 167:447-454) is an RSF1010 derivative that carries the Pm promoter and xylS regulatory gene.

Schumann et al. (*Plasmid* 2005; 54:241-248) have described series of plasmid-based expression vectors for *Bacillus subtilis* that allow stable intracellular expression of recombinant proteins. These expression vectors are based on the *E. coli-B. subtilis* shuttle vector pMTLBS72 which replicates in *B. subtilis* as theta circles and is consequently more stable than typical *B. subtilis* plasmids such as pUB110 which replicates via a rolling circle mechanism. Derivatives of this plasmid which contain constitutive promoter PlepA, promoter PgsiB which can be induced by heat and acid shock, and by ethanol, and the PxylA and Pspac promoters which respond to the addition of xylose and IPTG, respectively, have been described.

Broad-host-range plasmid pBHR1 (Szpirer et al., *J. Bacteriol.* 2001; 183:2101-10), which is reported to be compatible with IncP and IncQ plasmids, was purchased from MoBiTec GmbH (Goettingen, Germany). This plasmid was modified to create a vector (pDD54) employing the Pm/xylS expression system referenced above. The first step in constructing the pBHR1-based expression vector was to delete the kanamycin resistance (KanR) gene present on that plasmid. This was desirable because pRK2013, a plasmid that can be used to direct conjugal transfer of pBHR1 and derivatives, also carried a KanR gene. Moreover, deletion of that gene, and flanking sequences, facilitated certain subsequent cloning steps detailed below. pBHR1 also carries a gene that confers chloramphenicol-resistance (CamR) and that antibiotic can be used instead of kanamycin to select for this plasmid. Plasmid DNA was prepared from pBHR1 (diagrammed in FIG. 8A) digested with SbfI and the 1.2 kb SbfI fragment containing the KanR gene was deleted by ligating the digestion products and screening for chloramphenicol-resistant, kanamycin-sensitive transformants. The plasmid from one such transformant was designated pDD39 (see FIG. 8A) and used in further construction steps.

The xylS gene, which positively regulates expression from the Pm promoter, was amplified by PCR from pWW0 (TOL plasmid) DNA prepared from *Pseudomonas putida* ATCC 33015. Using the QIAGEN Plasmid Mini Kit (QIAGEN Inc., Valencia, Calif.) according to the vendor protocol 4 µg of pWW0 DNA was isolated from 20 mL of a fresh overnight culture of *Pseudomonas putida* ATCC 33015. This DNA preparation was used as template for PCR reactions which amplified the xylS gene and flanking DNA sequences as two fragments which were subsequently joined together by a subsequent PCR splicing reaction. This procedure facilitated the addition of a NsiI site 9 base pairs downstream of (3-prime to) the translational stop codon of xylS. In the initial round of PCR one reaction (Reaction A) employed primers DHD197 (SEQ ID NO:103) and DHD201 (SEQ ID NO:104) and a second reaction (Reaction B) employed primers DHD200 (SEQ ID NO:105) and DHD198 (SEQ ID NO:106). Sequences of these primers are as follows:

DHD197
(SEQ ID NO: 103)
5>GCACTGCAGATCCCCTTTATCCGCC>3

DHD198
(SEQ ID NO: 106)
5>GCACTGCAGATCCACATCCTTGAAGGC>3

DHD200
(SEQ ID NO: 105)
5>GATTACGAACGATGCATAGCCGAAGAAGGGATGGGTTG>3

DHD201
(SEQ ID NO: 104)
5>CTTCTTCGGCTATGCATCGTTCGTAATCAAGCCACTTCC>3

PCR reactions were performed using PfuUltra II polymerase (STRATAGENE, LaJolla, Calif.) according to the vendor protocols. In each 100 µL reactions, primers were added to a final concentration of 0.4 µM each, dNTPs were added at a final concentration of 200 µM each and 10 nanograms of pWW0 DNA was added as template. PCR reactions were performed in a Perkin-Elmer GeneAmp 2400 thermocyler using the following cycling parameters: 1 cycle of 2 min. at 95° C.; 30 cycles of 20 sec. at 95° C., 20 sec. at 60° C., and 45 sec. at 72° C.; 1 cycle of 3 min. at 72° C.; and a hold at 4° C. Products of these reactions were analyzed by agarose gel electrophoresis. The sizes of PCR products observed were consistent with the expected sizes for the products of both Reaction A (1259 bp) and Reaction B (422 bp).

The products of these reactions were purified using the Qiagen QIAquick PCR Purification Kit (QIAGEN, Valencia, Calif.) according to the vendor protocol, and 1 µL of each was added to 1 mL of sterile distilled deionized water. To 50 µL of this mixture was added 10 µL of 10× PfuUltra II reaction buffer, 10 µL of a stock solution of dNTPS (10 mM each), 10 µL of a stock solution of DHD197 (4 µM), 10 µL of a stock solution of DHD198 (4 µM), 16 µL of sterile distilled deionized water and 2 µL of PfuUltra II polymerase. The PCR reaction was performed using the procedure described above for Reactions A and B. The products of this reaction were purified using the Qiagen QIAquick PCR Purification Kit (QIAGEN, Valencia, Calif.) according to the vendor protocol and analyzed by agarose gel electrophoresis. A strong band was observed at a position consistent with the expected size of the product of the PCR splicing reaction, 1610 bp. This band was excised from the gel using the QIAquick Gel Extraction Kit (QIAGEN Inc., Valencia, Calif.) according to the vendor protocol.

This PCR fragment was cloned into the pCR-Blunt II-TOPO cloning vector (Invitrogen, Carlsbad, Calif.) according to the vendor protocol. The resulting plasmid was designated pDD42 and is diagramed in FIG. 8A. The PCR primers DHD197 and DHD198 added PstI sites 3 base pairs from each end of the 1610 bp PCR fragment. The sequence of the PstI fragment in pDD42 was determined (SEQ ID NO:107). This sequence matched the expected sequence for the xylS gene based on the reported pWW0 sequence (GenBank, AJ344068) and showed the addition of 5 base pairs derived from primers DHD200 and DHD201 which results in the creation of a NsiI site 9 base pairs downstream (3') of the translational stop codon of xylS. In the non-coding region downstream of xylS, two sequence differences were observed between the cloned PstI fragment in pDD42 and the sequence reported in GenBank, AJ344068. Insertions of a G residue are observed 119 and 181 bp 3' to the TGA stop codon of the xylS gene. These sequence differences occur within the intergenic region between xylS and xylH genes.

The PstI fragment containing the xylS gene was excised from pDD42, gel-purified and cloned into the SbfI site of pDD39. PstI and SbfI enzymes create digestion products having identical 4 bp overhangs, which can be ligated together, but the SbfI recognition site is destroyed in the resulting recombinants. The pDD39 derivative containing the xylS gene contained on the PstI fragment from pDD42 was termed pDD47 and is shown in FIG. 8A.

A 470 bp DNA fragment (SEQ ID NO:79) that comprises approximately 90 bp of TOL plasmid DNA sequence spanning the minimal Pm promoter sequences required for binding of RNA polymerase and the xylS protein (Dominguez-Cuevas et al., 2008) plus synthetic upstream and downstream transcriptional terminators and multiple restriction sites for cloning genes immediately downstream of the Pm promoter was synthesized de novo by DNA 2.0 (Carlsbad, Calif.). FIG. 8B shows pJ201:11352 which contains this 470 bp fragment cloned in the DNA 2.0 pJ201 vector. The promoter-containing fragment was designed with flanking AccI sites to allow cloning into the compatible, and supposedly, unique BstB I site located in pBHR1 and the derivative pDD47 plasmid. However, digestion of pDD47, and subsequently pBHR1, revealed the presence of two BstBI sites. Evidently, the sequence of pBHR1 as reported in the literature (GenBank: Y14439.1) is not entirely correct. Due to this discrepancy additional cloning steps were required to add the cloned Pm promoter to pDD47.

Figure 8A:
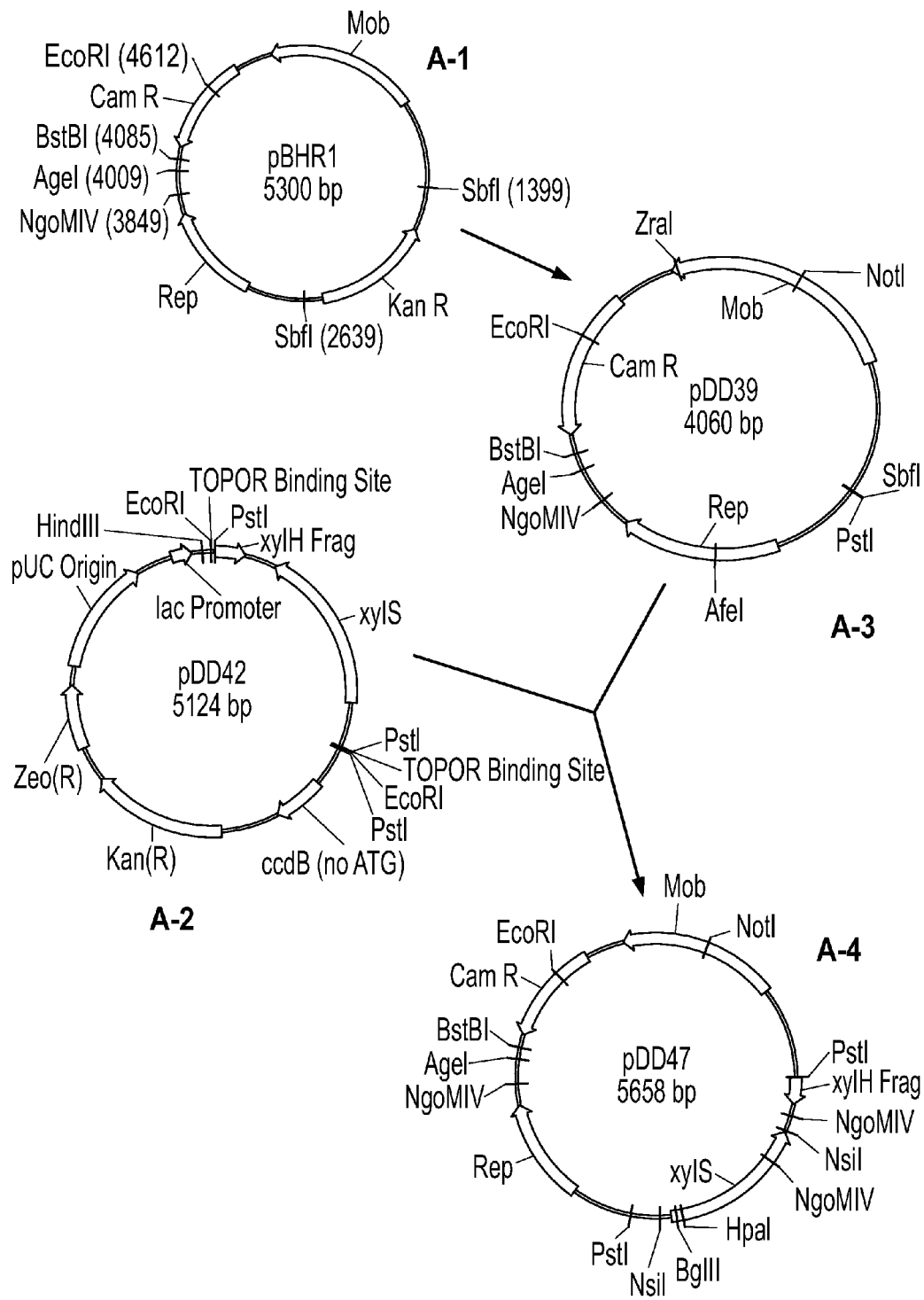
FIGS. 8A-8U represent the DNA maps for plasmids and DNA fragments pBHR1, pDD39, pDD42, pDD47, pREZ6, pDD49, pJ201:11352, pDD50, pDD54, pJ241:10662, pJ241:10664, pJ241:10663, pDD37, pDD38, pDD51, pDD52, pDD57, pDD58, pDD61, pDD62, pDD63, pDD59, pDD67, pDD60, pDD66, pBR1052, pMAK-CL, pDD74, pDD76, pDD73, pDD77, pDD79, pDD80, pCX045, pCS048, pCX039, pCX044, pCX040, pCX042, pCX041, pCX043, MSC467, MSC561, and pBR1087 of the present invention.
Figure 8B:
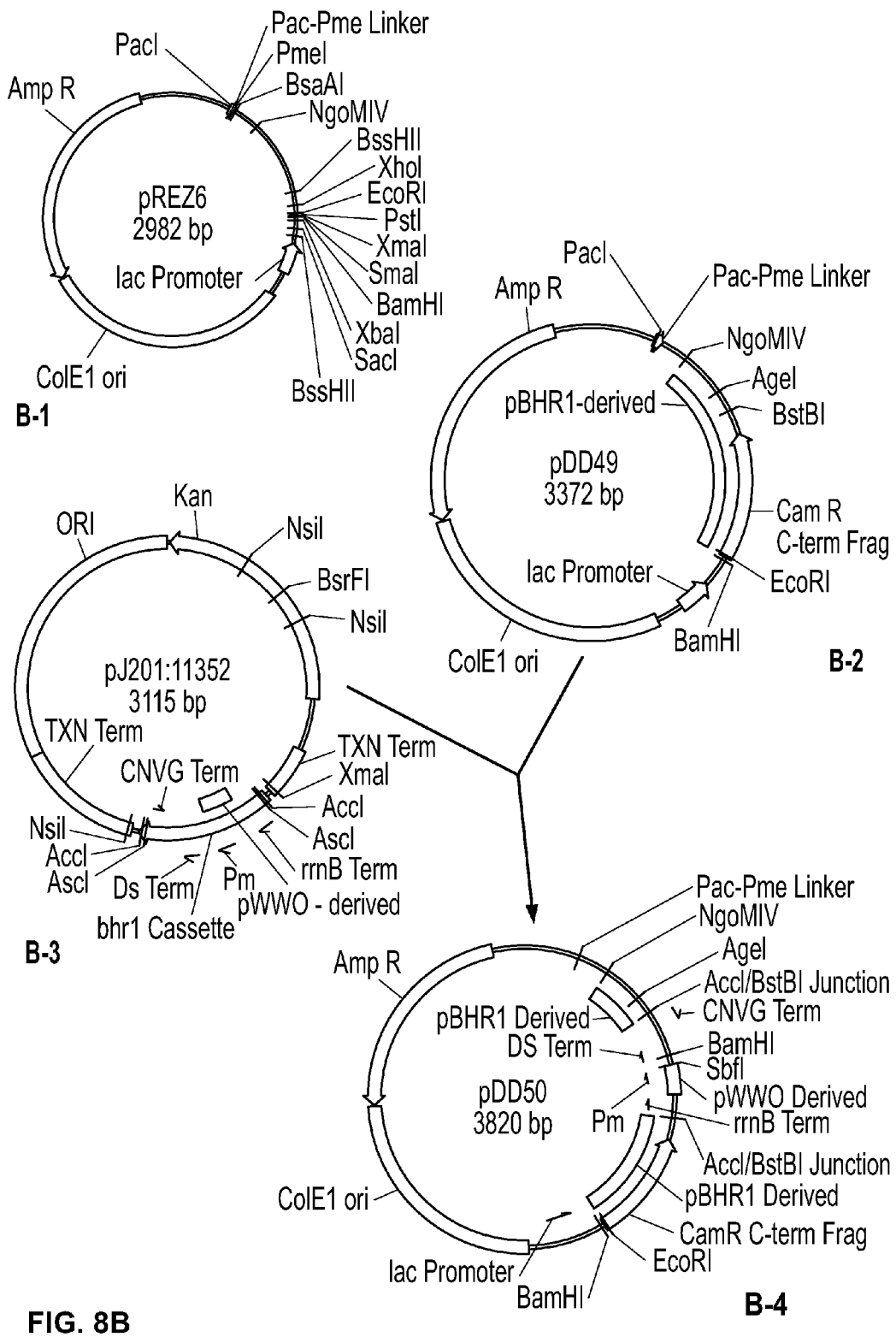
Figure 8C:
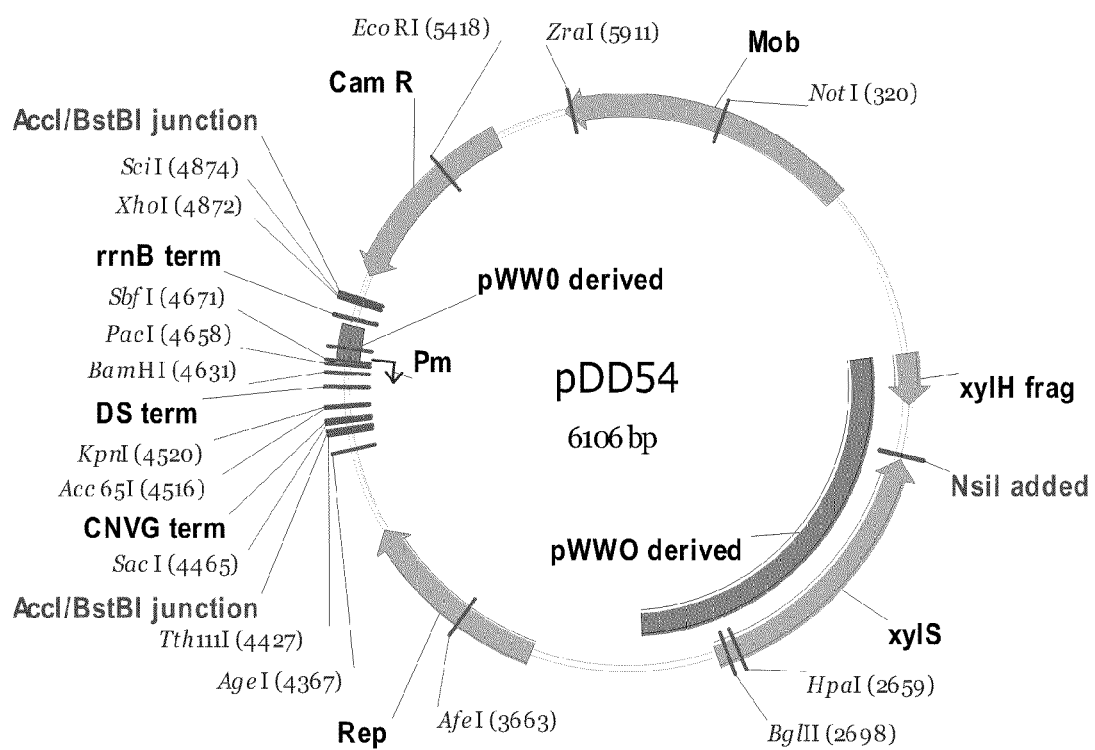

As shown in FIG. 8A, pDD47 contains unique EcoRI and AgeI sites that flank the annotated BstB I site targeted for insertion of the promoter. It also contains an NgoM IV site downstream of the AgeI site. The 763 bp EcoRI-NgoMIV fragment of pDD47 was excised and cloned into EcoRI-NgoMIV cut pREZ6 to generate pDD49 (FIG. 8B). pREZ6, also diagrammed in FIG. 8B, is a derivative of pBluescript SK+ (Stratagene, LaJolla, Calif.) in which a short polylinker sequence (ttaattaagggtttaaactac (SEQ ID NO:142)) was inserted at the unique DraIII site of pBluescript SK+. In this construct, the BstBI of interest is unique, so the AccI fragment of pJ201:11352 which contains the Pm promoter was excised and cloned into the BstBI site of pDD49 to create pDD50. Subsequently, the EcoRI-AgeI fragment of pDD50 was excised and ligated to the 5055 bp EcoRI-AgeI fragment of pDD47 to create the expression vector pDD54 which is shown in FIG. 8C. pDD54 was used as the expression vector in the initial cloning of K4 capsule genes for transfer into, and expression in, alternative hosts as described below and in Examples 6, 7, 8 and 9.

Figure 8D:
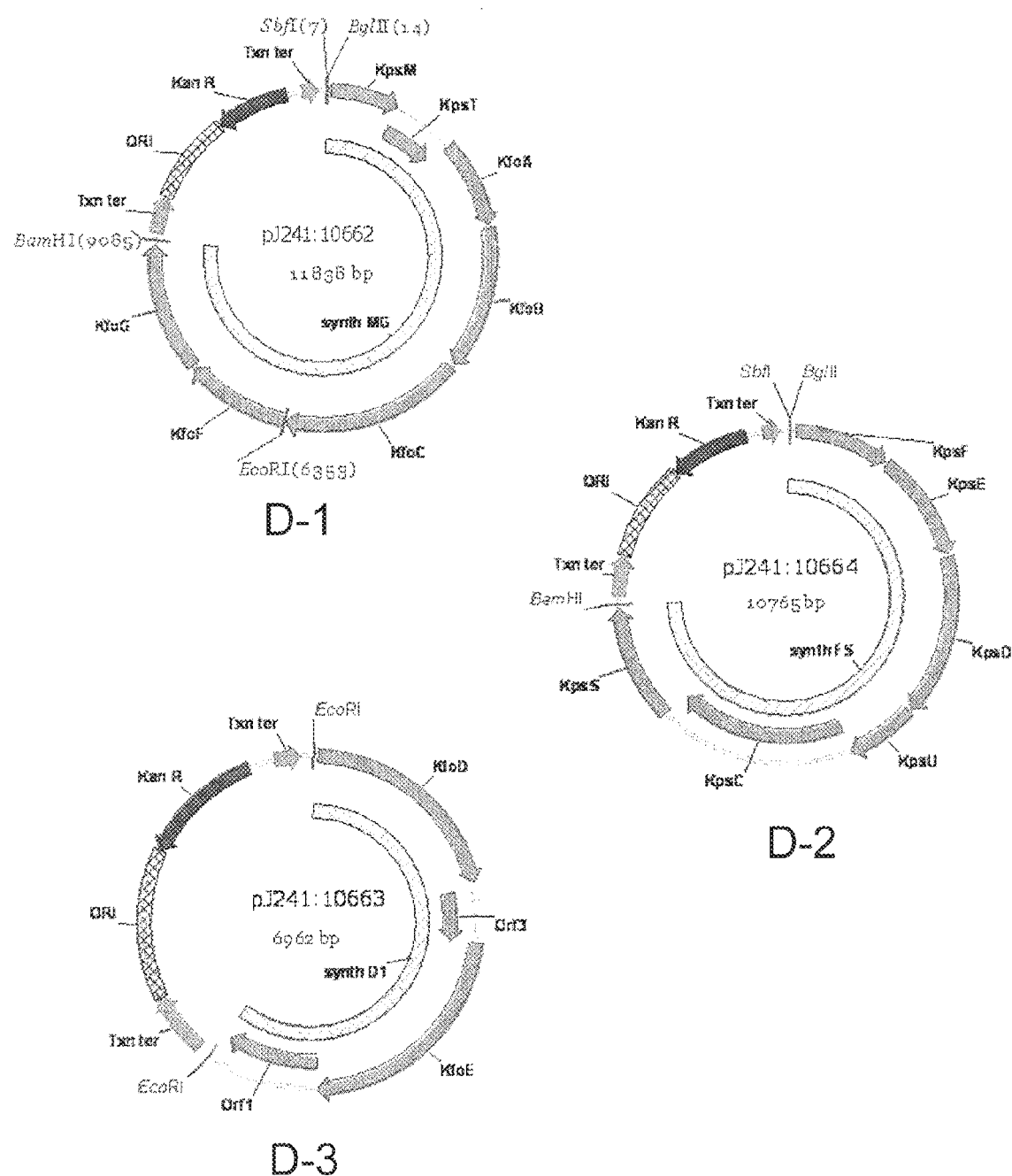

The three synthetic gene fragments kpsFEDUCS (FS segment), kpsMTkfoABCFG (MG segment) and kfoDIEH (DH segment) were received from the synthesis vendor, DNA2.0 (Carlsbad, Calif.). The synthetic DNAs were provided as fragments cloned in the plasmid vector, pJ241. FIG. 8D shows plasmid diagrams of these constructs. The synthetic genes were assembled into a single operon which was subsequently cloned into pDD54. The first step in this process was to combine the FS and MG segments into a single fragment. Two plasmids were constructed that combine the FS segment and the MG segment in different permutations on the plasmid vector, pJ241.

Aliquots of plasmids pJ241:10662 and pJ241:10664 were digested with SbfI+BglII, treated with alkaline phosphatase and gel-purified using the QIAEX II Gel Extraction Kit (Qiagen Inc., Valencia, Calif.) according to the vendor protocol. In parallel, aliquots of pJ241:10662 and pJ241:10664 DNA were digested with SbfI plus BamHI and the resulting approximately 9.1 kb and approximately 8.0 kb SbfI-BamHI fragments containing the synthetic MG and FS gene segments, respectively, were gel-purified as above. The gel-purified approximately 9.1 kb SbfI-BamHI MG segment was ligated into the SbfI plus BglII digested and phosphatased pJ241:10664 vector which contains the FS gene segment. Although BamH I and BglII enzymes recognize different sequences, GGATCC vs AGATCT respectively, they produce an identical 4 bp overhang (GATC) and therefore the digestion products can be ligated together but resulting ligation products cannot subsequently be recognized by either enzyme. The resulting recombinant plasmid, designated pDD37, is shown in FIG. 8E. This construct retains the SbfI site 5' to the synthetic genes and the BamHI site, present in pJ241:10664, 3' to the synthetic genes. The synthetic gene set kpsMTkfoABCFGkpsFEDUCS (MGFS segment), can therefore be excised as an SbfI-BamHI fragment of approximately 17.1 kb. Similarly, the gel-purified SbfI-BamHI approximately 8.0 kb FS segment was ligated into the SbfI and BglII digested and phosphatase treated pJ241:10662 vector which contains the MG gene segment. The resulting recombinant plasmid, designated pDD38, is shown in FIG. 8E. Again, this construct retains the SbfI site 5' to the synthetic genes and the BamHI present in pJ241:10662 3' to the synthetic genes. Therefore, this synthetic gene set, kpsFEDUCSkpsMTkfoABCFG (the FSMG segment) can be excised as an SbfI-BamHI fragment of approximately 17.1 kb.

Figure 8F:
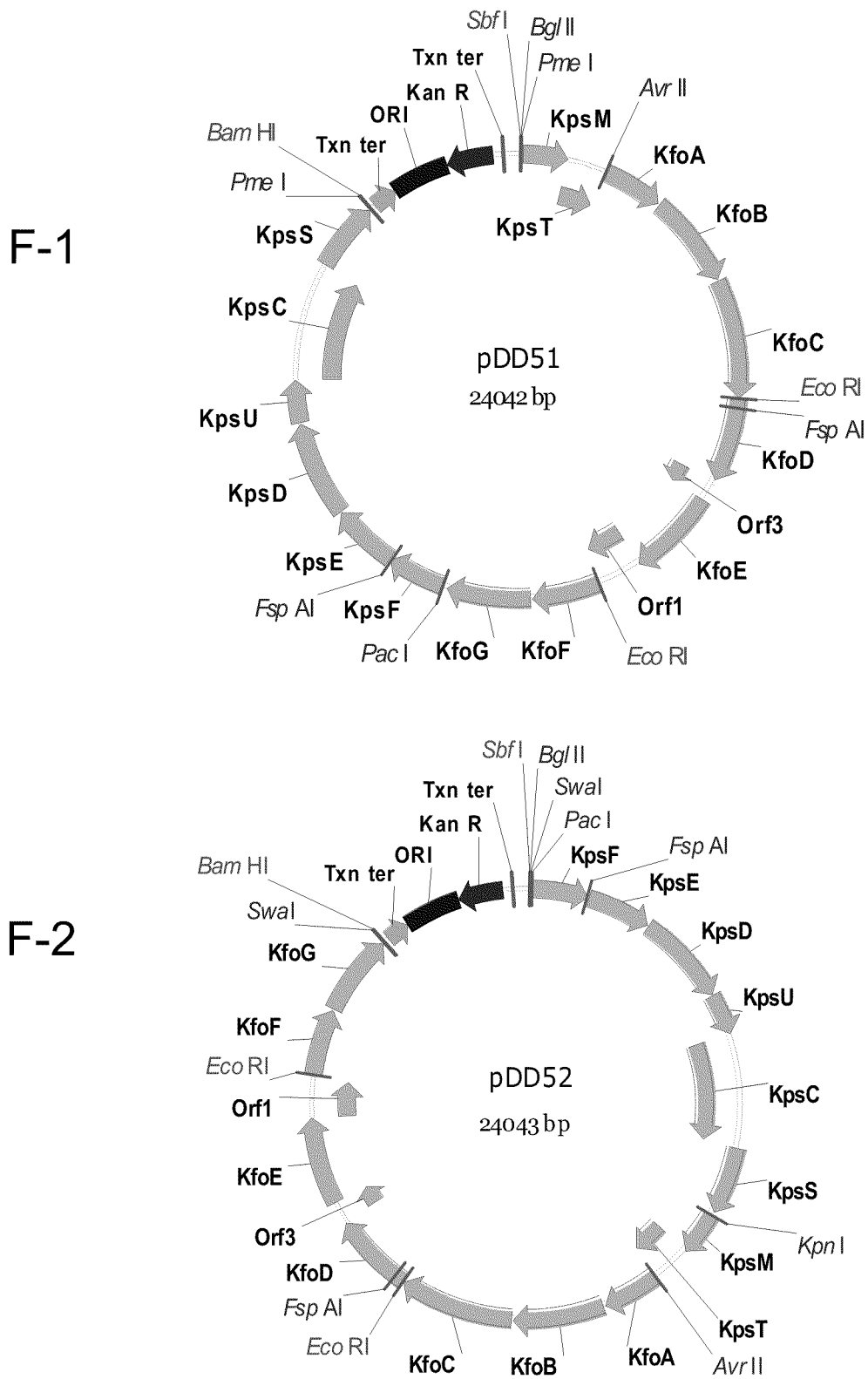

Synthetic genes kfoD, kfoI (or orf3), kfoE and kfoH (or orf1) (the DH segment), contained in pJ241:10663 (see FIG. 8D), were cloned into plasmids pDD37 and pDD38. Plasmids pDD37 and pDD38 were digested with EcoRI, treated with alkaline phosphatase and gel-purified using the QIAEX II Gel Extraction Kit (Qiagen Inc., Valencia, Calif.) according to the vendor protocol. The unique EcoRI site in each of these plasmids is located in the intergenic region separating kfoC and kfoF. The DH segment, containing synthetic genes kfoD, kfoI, kfoE and kfoH, was excised from pJ241:10663 as a approximately 4.2 kb EcoRI fragment and gel-purified. This fragment was ligated into both of the EcoRI-cut and phosphatased pDD37 and pDD38 plasmids. Resulting recombinants were tested for orientation of the approximately 4.2 kb EcoRI fragment by cutting with diagnostic restriction enzymes. Recombinants that contained the added DH segment in the correct orientation were readily obtained. The resulting plasmids, pDD51, derived from pDD37, and pDD52 derived from pDD38, are shown in FIG. 8F. These constructs each contain all of the K4 capsule cluster genes but, as shown, the gene order differs for the two plasmids: in pDD51 the gene order is kpsMTkfoABCDIEHFGkpsFEDUCS, in pDD52 the order is kpsFEDUCSkpsMTkfoABCDIEHFG. In both cases the entire K4 gene set can be excised as an SbfI-BamHI fragment of approximately 21 kb. The K4 capsule genes from these plasmids were subcloned into the expression vector pDD54, described above, to generate expression plasmids pDD57 and pDD58, respectively. Both of these plasmids are illustrated in FIG. 8G. The entire synthetic K4 capsule gene set was excised from pDD51 and pDD52 as an approximately 21 kb SbfI-BamHI fragment, gel-purified using the QIAEX II Gel Extraction Kit (Qiagen Inc., Valencia, Calif.) according to the vendor protocol and cloned into SbfI-BamHI digested pDD54.

In pDD57 and pDD58 the entire K4 capsule gene set (17 genes) is under control of the Pm promoter and the XylS regulatory protein encoded by the xylS gene. The pDD54 and pDD58 plasmids were originally constructed in the E. coli "TOP10" strain, a commercially available (Invitrogen, Carlsbad, Calif.) strain that contains a number of mutations that enhance its utility for gene cloning. The plasmids were also subsequently transferred into another E. coli host ("DH5α") that is commonly used in recombinant DNA experiments. These E. coli strains are not ideal candidates for development as production platforms. Therefore, in initial experiments, pDD54 and pDD58 were transformed into more suitable E.

*coli* K-12 strains and the resulting strains tested for chondroitin production as described below in Example 6.

Additional expression plasmids also were constructed by modification of pDD57 and pDD58. A tetracycline-resistance gene was added to expression plasmids pDD57 and pDD58 as detailed below. Tetracycline-resistance potentially has two advantages as a selection for plasmid introduction and maintenance. First, tetracycline-resistance (TcR) is typically a more stringent selection for plasmid maintenance because the resistance mechanism is based on transport of the antibiotic DHD218 replaces the sequence ATCGATAAGCTT (nucleic acids 2843-2854 of SEQ ID NO:141) that is present in pCX027 and, in so doing, eliminates the ClaI and HindIII sites located in the tetR promoter region and changes the sequence of the −10 region of the anti-tet promoter. The complementary shaded sequences of DHD219 and DHD220 create a silent mutation that eliminates the BamHI site of the tetR gene of pCX027. This mutation changes a CTC leucine codon to a TTG leucine codon and thus does not alter the amino acid sequence of the TetR protein.

```
DHD218  5>  GCGAGATCTCATGTTTGACAGCTTATCATCGCTCGGCTTTAATGCGGTAGTTTATCAC  >3  (SEQ ID NO: 113)
DHD219  5>  CCGGCGTACAAGATCCACAGGACGGGTGTG                            >3  (SEQ ID NO: 114)
DHD220  5>  CTGTGGATCTTGTACGCCGGACGCATCGTG                            >3  (SEQ ID NO: 115)
DHD221  5>  GCGGATCCTTCCATTCAGGTCGAGGTG                               >3  (SEQ ID NO: 116)
``` out of the cell, not on inactivation of the antibiotic, as is the case for chloramphenicol and many other antibiotics. Therefore, the effective concentration of selective agent in the culture medium is unaltered by cell growth and metabolism. Second, spontaneous chromosomal mutations conferring resistance to tetracycline are uncommon, and were not observed in X. campestris. In contrast, spontaneous chromosomal mutations conferring resistance to chloramphenicol were observed in *X. campestris* in plasmid transfer experiments such as those described in Example 6. These mutations can potentially obscure CmR transformants/ex-conjugants that acquired a plasmid of interest, such as pDD57 or pDD58.

Expression plasmids pDD57 and pDD58 were modified by addition of a gene that confers the property of tetracycline-resistance (TcR) while the chloramphenicol-resistance (CmR) property of these plasmids was retained. A tetracycline-resistance gene (tetR) present in plasmid pCX027 (described in Example 3 and FIG. 7B above), and derived from the *E. coli* plasmid vector pBR322, was amplified by PCR and cloned into the unique BamHI sites present in pDD57 and pDD58. In the process of amplifying and cloning the tetR gene, this gene was modified as follows. PCR primers added a BglII site at the 5' end of the tetR gene, upstream of the promoter, and a BamHI site 3' to the tetR stop codon. Primers further modified the gene to eliminate an internal BamHI site (without changing the amino acid sequence of the protein) and to eliminate the so-called "anti-tet" promoter normally present on the fragment that was amplified. This promoter is located near the tetR promoter but directs transcription in the opposite direction (Balbas et al., Gene 1986; 50:3-40). This modified tetR gene was created by performing two PCR reactions that amplified two overlapping segments of the tetR gene and introduced the desired sequence changes. Subsequently a these two fragments were joined together by a subsequent PCR splicing reaction to generate the tetR gene and promoter region of the desired sequence having the BglII site at the 5' end of the tetR gene, upstream of the promoter, and a BamHI site 3' to the tetR translational stop codon.

The first PCR reaction (Reaction A) employed primers DHD218 (SEQ ID NO:113) and DHD219 (SEQ ID NO:114) to amplify approximately 400 bp of DNA including the amino-terminal portion of the tetR coding sequence and upstream promoter sequence. The second reaction (Reaction B) employed primers DHD220 (SEQ ID NO:115) and DHD221 (SEQ ID NO:116) to amplify approximately 900 bp of DNA including the remainder of tetR coding sequence and translational stop codon. Sequences of these primers are as follows shown below. The shaded sequence shown in PCR Reactions A and B were performed using PfuUltra II polymerase (Stratagene, LaJolla, Calif.). In each 40 µL reaction, Pfu reaction buffer (supplied by the vendor) was added to a final concentration of 1×, primers were added to a final concentration of 0.4 µM each, dNTPs were added at a final concentration of 200 µM each, 1 ng of pCX027 plasmid DNA was added as template and 2.5 units of PfuUltra II polymerase were added. PCR Reactions A and B were performed in a RoboCycler® Gradient 96 thermocycler (Stratagene, LaJolla, Calif.) using the following cycling parameters: 1 cycle of 1 min. at 95° C.; 30 cycles of 30 sec. at 95° C., 30 sec. at 55° C., and 30 sec. at 72° C.; 1 cycle of 5 min. at 72° C.; and a hold at 6° C. The products of these reactions were purified using the Qiagen QIAquick PCR Purification Kit (QIAGEN, Valencia, Calif.) according to the vendor protocol, and analyzed by agarose gel electrophoresis. The sizes of PCR products observed were consistent with the expected sizes for the products of both Reaction A (395 bp) and Reaction B (920 bp). These fragments were excised from the gel and eluted from the gel slices using the QIAquick Gel Extraction Kit (QIAGEN Inc., Valencia, Calif.) according to the vendor protocol and recovered in 30 µL of EB elution buffer. The gel-purified fragments served as templates in the subsequent PCR splicing reaction; Reaction SP. In a 50 µL reaction, Pfu reaction buffer was added to a final concentration of 1×, primers were added to a final concentration of 0.4 µM each, dNTPs were added at a final concentration of 200 µM each, 3 µL of each of the gel-purified reaction products of Reactions A and B were added as template and 2.5 units of PfuUltra II polymerase were added. PCR Reaction SP was performed in a RoboCycler® Gradient 96 thermocycler (Stratagene, LaJolla, Calif.) using the following cycling parameters: 1 cycle of 1 min. at 95° C.; 30 cycles of 30 sec. at 95° C., 30 sec. at 55° C., and 30 sec. at 72° C.; 1 cycle of 5 min. at 72° C.; and a hold at 6° C. The product of this reaction was purified using the QIAGEN QIAquick PCR Purification Kit (QIAGEN, Valencia, Calif.) according to the vendor protocol, and was analyzed by agarose gel electrophoresis. A strong band was observed at a position consistent with the expected size of the product of the PCR splicing reaction, 1295 bp.

Figure 8H:
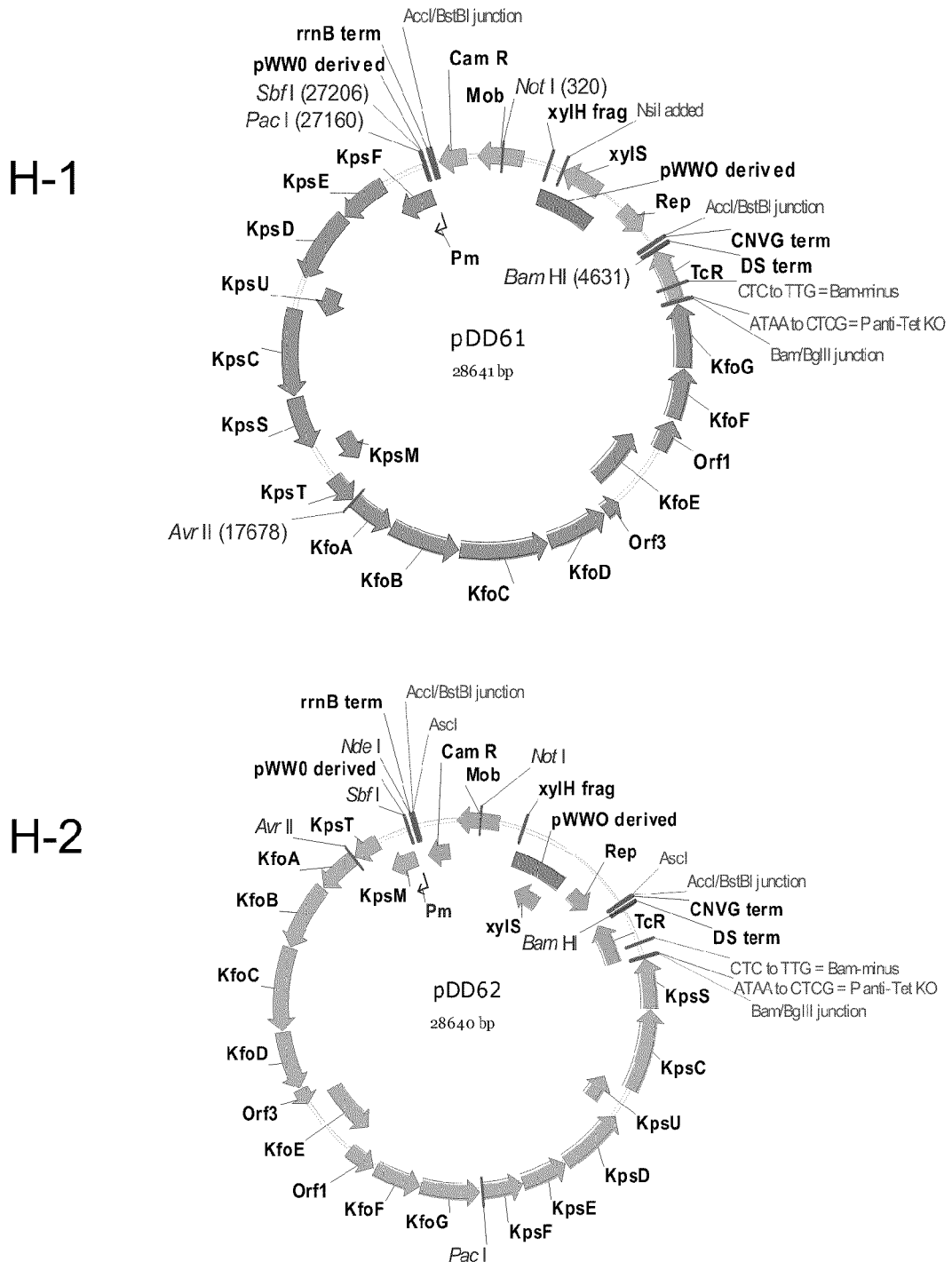

This PCR product was digested with BglII and BamHI and ligated with BamHI-digested pDD57 and pDD58. Ligation products were used to transform *E. coli* TOP10 (Invitrogen, Carlsbad, Calif.) and transformants that had acquired tetracycline resistance were selected by plating at 30° C. on LB plates containing 10 µg/mL tetracycline. Resulting tetracycline-resistant transformants were screened by diagnostic PCR reactions and restriction digests to confirm the presence, and determine the orientation, of the tetR gene. Plasmids having the desired structure were identified and designated pDD61 (pDD57::tetR) (SEQ ID NO:143) and pDD62 (pDD58::tetR) (SEQ ID NO:144). Diagrams of these plasmids are shown in FIG. 8H. The analogous insertion of the tetR gene was made into the BamHI site of vector pDD54 to generate pDD63; shown in FIG. 8I. This plasmid can serve as a TcR vector-only control for experiments with any of the TcR plasmids that express cloned K4 genes.

The synthetic gene set contains restriction sites that allow non-polar deletions of any gene(s) of interest to be created. The set of four genes kfoDIEH was deleted by deletion of a single 4.2 kb EcoRI fragment. This 4.2 kb EcoRI fragment was deleted from expression plasmids pDD57 and pDD58 and from their respective TcR derivatives, pDD61 and pDD62 which are described above. These four plasmids, shown in FIGS. 8G and 8H, all contain 3 EcoRI sites. Two sites define the 4.2 kb fragment of interest and the third site cleaves within the coding sequence of the plasmid gene that confers chloramphenicol-resistance (CmR). Each of these plasmids was digested to completion with EcoRI and the resulting digestion products were religated. Following transformation with the ligation products, CmR transformants were selected and analyzed by restriction endonuclease digestion. Plasmids deleted for the 4.2 kb EcoRI fragment were readily obtained in all instances. Plasmids pDD59, pDD60, pDD67 and pDD66 are the 4.2 kb EcoRI fragment deletion derivatives of pDD57, pDD58, pDD61 and pDD62, respectively, and all are deleted for the kfoDIEH genes. These plasmids are depicted in FIG. 8J.

Western blot analyses of expression of the cloned K4 genes (See Example 5 below) indicated that in E. coli strains containing pDD66, the expression of the kpsFEDUCS genes was less than optimal. Therefore, pDD66 was modified to incorporate a promoter (Pm) in the intragenic region between kfoG and kpsF. In pDD66, this intergenic region contains a unique PacI site and two ClaI sites as shown in FIG. 8K. Digestion with PacI and ClaI, excises 2 fragments, a 34 bp ClaI fragment and a 12 bp ClaI-PacI fragment and leaves the larger vector fragment with ClaI and PacI ends. A 127 bp PacI-ClaI DNA fragment having the sequence:

```
                                         (SEQ ID NO: 80)
TTAATTAATGTTTCTGTTGCATAAAGCCTAAGGGGTAGGCCTTTCTAGA

GATAGCCATTTTTTGCACTCCTGTATCCGCTTCTTGCAAGGCTGGACTT

ATCCCTATCAAACCGGACACTGCATCGAT,
``` was inserted into the ClaI-PacI digested pDD66 vector fragment to generate pBR1052. The added 127 bp PacI-ClaI fragment includes a copy of the Pm promoter sequence. As shown in FIG. 8K, in pBR1052 the added copy of the Pm promoter is oriented so that transcription initiation at this promoter can result in RNA transcripts that include the kpsFEDUCS genes.

Expression plasmids, pDD66 and pBR1052 have been described above. To construct gene replacement vectors in order to insert the K4 chondroitin biosynthetic genes into the chromosome (as described in Example 10 below), the K4 chondroitin biosynthesis genes from pDD66 and pBR1052 were cloned into the pMAK-CL replacement vector which is described above in Example 3. The pMAK-CL vector, diagramed in FIG. 8L, contains cloned DNA regions upstream and downstream of the colanic acid (CA) gene cluster and a unique AscI cloning site at the junction of these regions. As detailed in Example 3, this vector was used to construct a deletion of the entire CA gene cluster in E. coli K-12 W3110 to generate strain MSC188. The K4 gene expression cassettes were excised and gel-purified, using the QIAEX II Gel Extraction Kit (Qiagen Inc., Valencia, Calif.) according to the vendor protocol, from pDD66 and pBR1052 as approximately 19 kb AscI fragments and these fragments were ligated with pMAK-CL DNA that was AscI-digested, phosphatase-treated, and gel-purified. Transformants were selected for resistance to tetracycline. The gene conferring resistance to tetracycline is present on the AscI fragments of pDD66 and pBR1052, along with the Pm promoter and the upstream and downstream transcription terminator sequences. Derivatives of pMAK-CL that contained the AscI fragments of pBR1052 or pDD66 were identified and designated pDD74 and pDD76 respectively. These plasmids are diagramed in FIG. 8L.

Figure 8I:
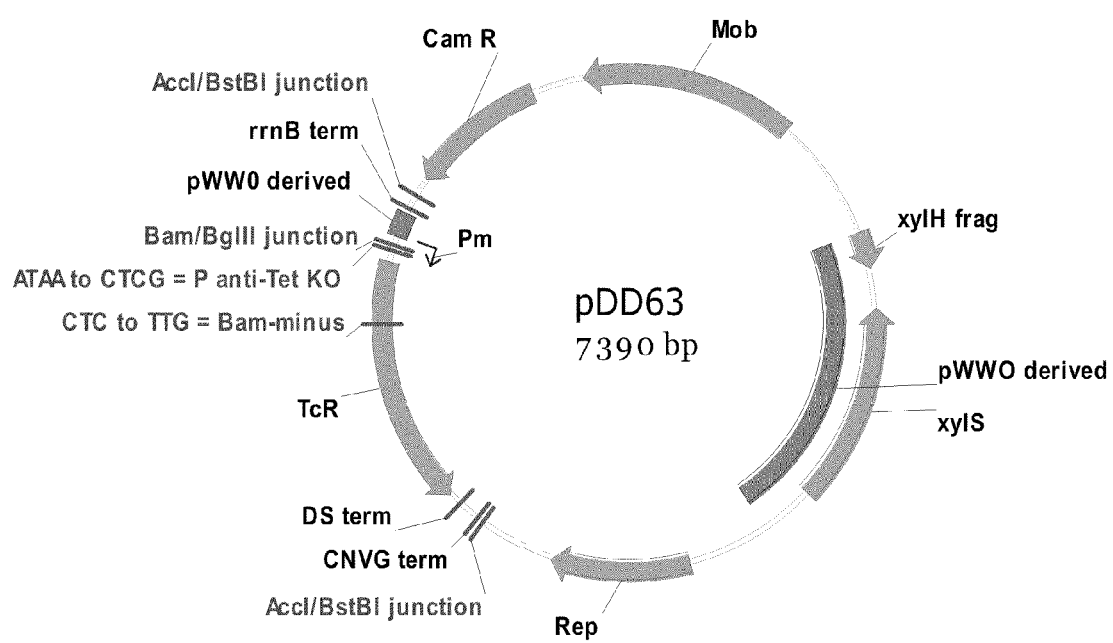
Figure 8K:
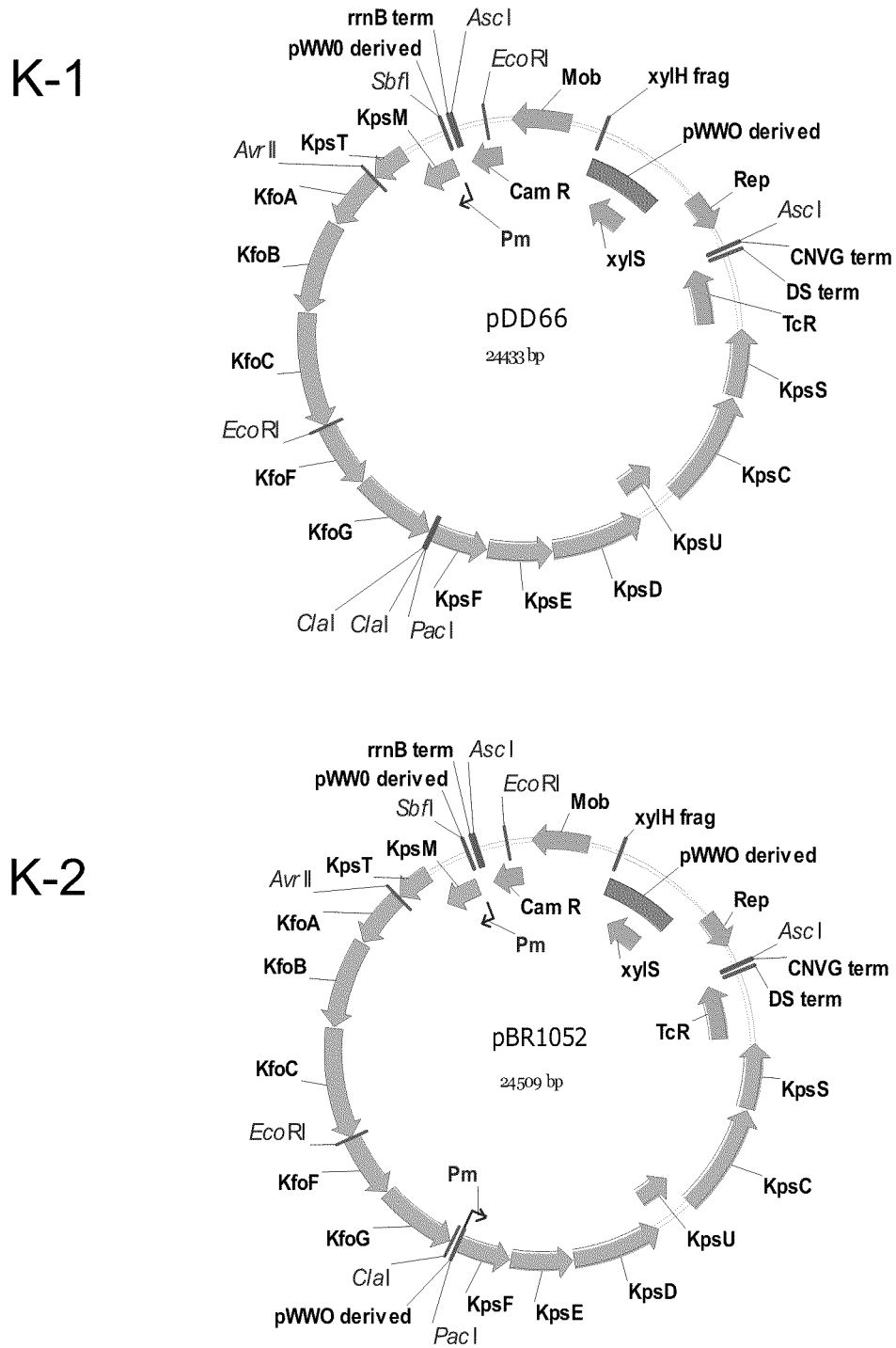
Figure 8L:
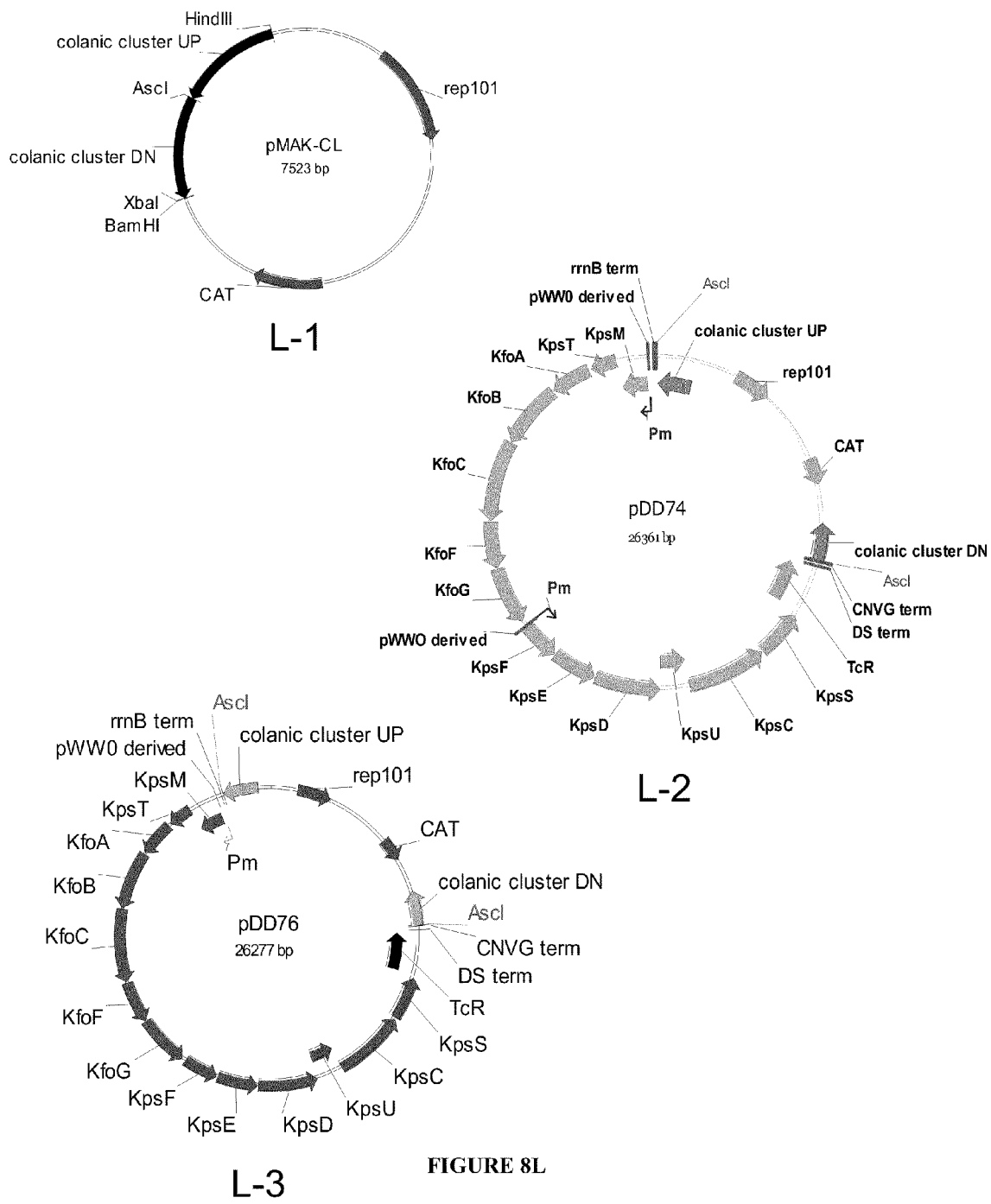
Figure 8M:
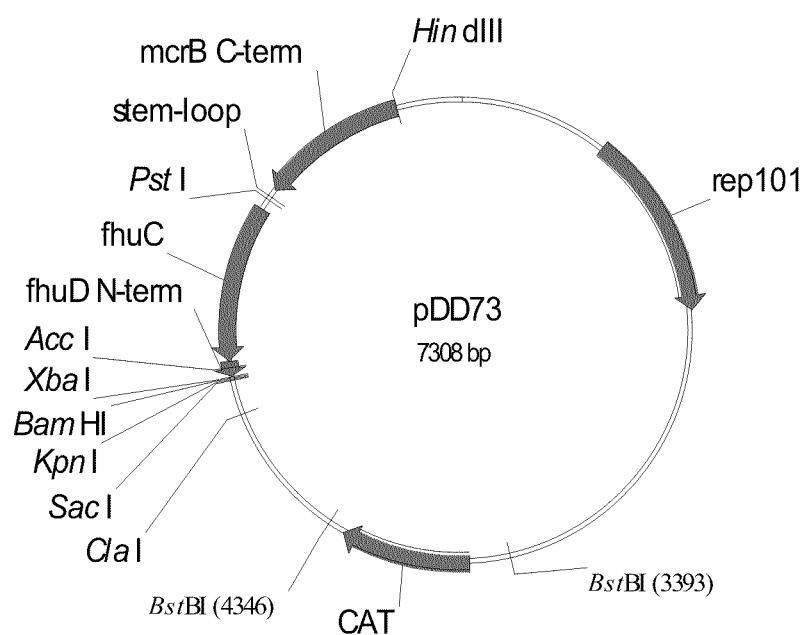

DNA regions upstream (5') and downstream of (3') the E. coli fhuA gene were cloned by PCR, assembled and sequenced, and this deletion fragment moved into the pMAK705 suicide plasmid to create a replacement vector for the fhuA locus termed pMAK705-4-fhuA, or pDD73 (FIG. 8M). DNA segments upstream and downstream of the fhuA gene were amplified by PCR from genomic DNA prepared from E. coli K-12 strain W3110 (See Example 3) and these two fragments were subsequently joined together by a subsequent PCR splicing reaction. This procedure facilitated the addition of a PstI site at the junction of the upstream and downstream DNA segments.

In the initial round of PCR one reaction (Reaction A) employed primers DHD236 (SEQ ID NO:108) and DHD237-S (SEQ ID NO:109) to amplify approximately 800 bp of DNA upstream of the fhuA gene and a second reaction (Reaction B) employed primers DHD238-S (SEQ ID NO:110) and DHD239 (SEQ ID NO:111) to amplify approximately 950 bp of DNA downstream of the fhuA gene. Sequences of these primers are as follows:

```
DHD236
                                        (SEQ ID NO: 108)
5>CGCAAGCTTCGTACCGAAAGATCAGTTGC>3

DHD237-S
                                        (SEQ ID NO: 109)
5>CCAAAAGAGAAATCTGCAGTAGATGGGATGTTATTTTACCG>3

DHD238-S
                                        (SEQ ID NO: 110)
5>ACATCCCATCTACTGCAGATTTCTCTTTTGGGGCACGG>3

DHA239
                                        (SEQ ID NO: 111)
5>GCTCTAGACATCTGCCATAACAACGGAG>3
```

PCR Reaction A was performed using PfuUltra II polymerase (Stratagene, LaJolla, Calif.). In a 50 µL reaction, Pfu reaction buffer (supplied by the vendor) was added to a final concentration of 1×, primers were added to a final concentration of 0.4 µM each, dNTPs were added at a final concentration of 200 µM each, 50 ng of W3110 genomic DNA was added as template and 2.5 units of PfuUltra II polymerase were added. PCR Reaction A was performed in a RoboCycler® Gradient 96 thermocycler (Stratagene, LaJolla, Calif.) using the following cycling parameters: 1 cycle of 1 min. at 95° C.; 30 cycles of 1 min. at 95° C., 1 min. at 55° C., and 1 min. at 72° C.; 1 cycle of 4 min. at 72° C.; and a hold at 6° C.

PCR Reaction B was performed using Herculase polymerase (Stratagene, LaJolla, Calif.). In a 50 µL reaction, Herculase reaction buffer (supplied by the vendor) was added to a final concentration of lx, primers were added to a final concentration of 0.4 µM each, dNTPs were added at a final concentration of 200 µM each, 25 ng of W3110 genomic DNA was added as template and 2.5 units of Herculase polymerase were added. PCR Reaction B was performed in a RoboCycler® Gradient 96 thermocycler (Stratagene, LaJolla, Calif.) using the following cycling parameters: 1 cycle of 2 min. at 92° C.; 33 cycles of 30 sec. at 95° C., 30 sec. at 50° C., and 1 min. at 72° C.; 1 cycle of 10 min. at 68° C.; and a hold at 6° C.

The products of these reactions were purified using the QIAGEN QIAquick PCR Purification Kit (QIAGEN, Valencia, Calif.) according to the vendor protocol, and analyzed by agarose gel electrophoresis. The sizes of PCR products observed were consistent with the expected sizes for the products of both Reaction A (832 bp) and Reaction B (949 bp). These fragments were excised from the gel and eluted from the gel slices using the QIAquick Gel Extraction Kit (QIAGEN Inc., Valencia, Calif.) according to the vendor protocol and recovered in 30 µL of EB elution buffer. The gel-purified fragments served as templates in the subsequent PCR splicing reaction; Reaction SP. In a 50 µL reaction, Pfu reaction buffer was added to a final concentration of 1×, primers were added to a final concentration of 0.4 µM each, dNTPs were added at a final concentration of 200 µM each, 3 µL of each of the gel-purified reaction products of Reactions A and B were added as template and 2.5 units of PfuUltra II polymerase were added. PCR Reaction SP was performed in a RoboCycler® Gradient 96 thermocycler (Stratagene, LaJolla, Calif.) using the following cycling parameters: 1 cycle of 1 min. at 95° C.; 33 cycles of 30 sec. at 95° C., 30 sec. at 60° C., and 40 sec. at 72° C.; 1 cycle of 5 min. at 72° C.; and a hold at 6° C. The product of this reaction was analyzed by agarose gel electrophoresis. A strong band was observed at a position consistent with the expected size of the product of the PCR splicing reaction, 1750 bp. This band was excised from the gel using the QIAquick Gel Extraction Kit (QIAGEN Inc., Valencia, Calif.) according to the vendor protocol. This fragment was then cloned into the pCR-Blunt II-TOPO cloning vector (Invitrogen, Carlsbad, Calif.) according to the vendor protocol and the sequence of the cloned PstI fragment was determined (SEQ ID NO:112).

This sequence matched the expected sequence for the DNA segments upstream and downstream of the fhuA gene based on the reported genome sequence for W3110 (GenBank, AP009048) and showed the addition, at the junction of the upstream and downstream segments, of the 6 bp PstI site derived from primers DHD237-S and DHD238-S. It also confirmed the addition of a HindIII site at the 5' end of the upstream DNA segment and an XbaI site at the 3' end of the downstream DNA segment which derive from primers DHD236 and DHD239 respectively. The sequence-verified PCR fragment was excised from the pCR-Blunt II-TOPO vector and gel-purified as a HindIII-XbaI fragment of 1739 bp and ligated with the temperature-sensitive pMAK705 vector (See Example 3) which was digested with HindIII and XbaI and treated with Antarctic Phosphatase (New England BioLabs, Ipswich, Mass.) according to the vendor protocol. Ligation products were used to transform E. coli NEB5α (New England BioLabs, Ipswich, Mass.) and chloramphenicol-resistant transformants obtained from plating at 30° C., the permissive temperature for pMAK705 replication, were analyzed by digestion with PstI, and XbaI plus HindIII, to identify those recombinants carrying the 1739 XbaI-HindIII by fragment containing the cloned DNA regions upstream and downstream of the E. coli fhuA gene. One such recombinant plasmid was designated as pDD73 (FIG. 8M) and was used in subsequent experiments.

The xylS regulatory gene was cloned into the pDD73 replacement vector as follows. The xylS gene was excised from pDD42 as a PstI fragment and cloned into the PstI site of pDD73 to generate pDD77, which is diagrammed in FIG. 8N. The PstI fragment of pDD77 that contains the xylS gene is identical to the xylS-containing PstI fragment present in expression plasmids pDD66 and pBR1052, the parent vector pDD54 and pDD63 the tetracycline resistant derivative of pDD54.

As detailed in Example 10 below, a synthetic optimized version of the xylS gene promoter, ribosome binding site, and 5' untranslated region (UTR) was designed and synthesized, and those modified sequences were introduced into the xylS replacement vector pDD77 and subsequently into the chromosome. A 257 bp BlpI-BglII fragment (SEQ ID NO:140) was synthesized by a commercial vendor (DNA2.0) and the synthetic DNA containing the modified sequences was cloned into the xylS replacement vector, pDD77, as a Blp I-Bgl II fragment in place of the native Blp I-Bgl II fragment containing the native xylS regulatory sequences. The plasmid containing the modified xylS was termed pDD79 (FIG. 8N).

Figure 8O:
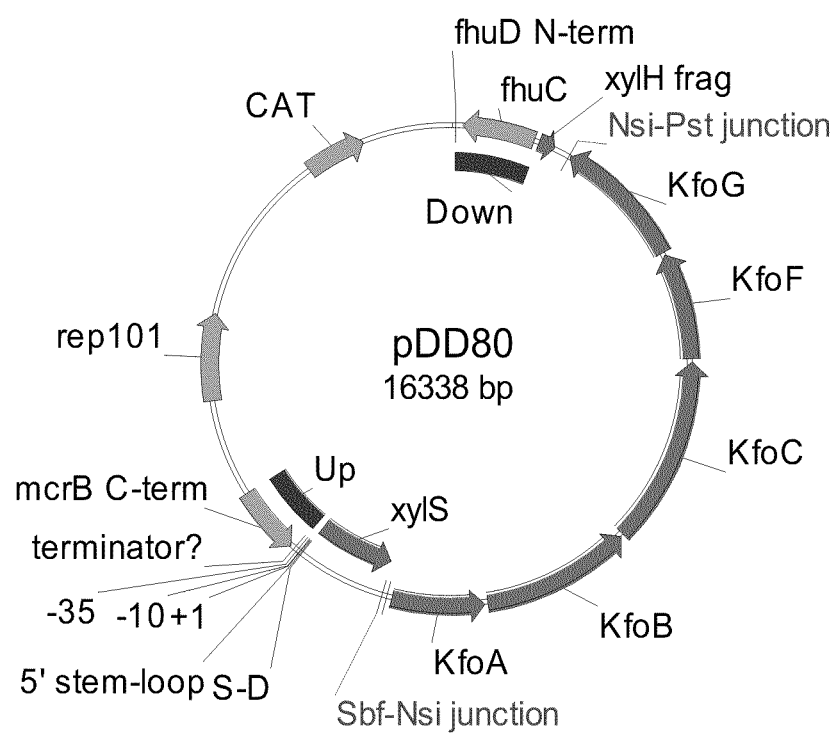

A replacement vector was constructed in order to insert a copy of the kfoABCFG gene segment into the E. coli K-12 chromosome at the fhuA locus. The kfoABCFG gene segment (without the Pm promoter) was excised from pCX039 on a PstI fragment and this fragment was cloned into the compatible NsiI site of pDD79 which is unique in this plasmid. In the resulting plasmid, pDD80 (FIG. 8O), the kfoABCFG genes are transcribed by the synthetic xylS promoter, which was designed to be a strong constitutive promoter.

Figure 8P:
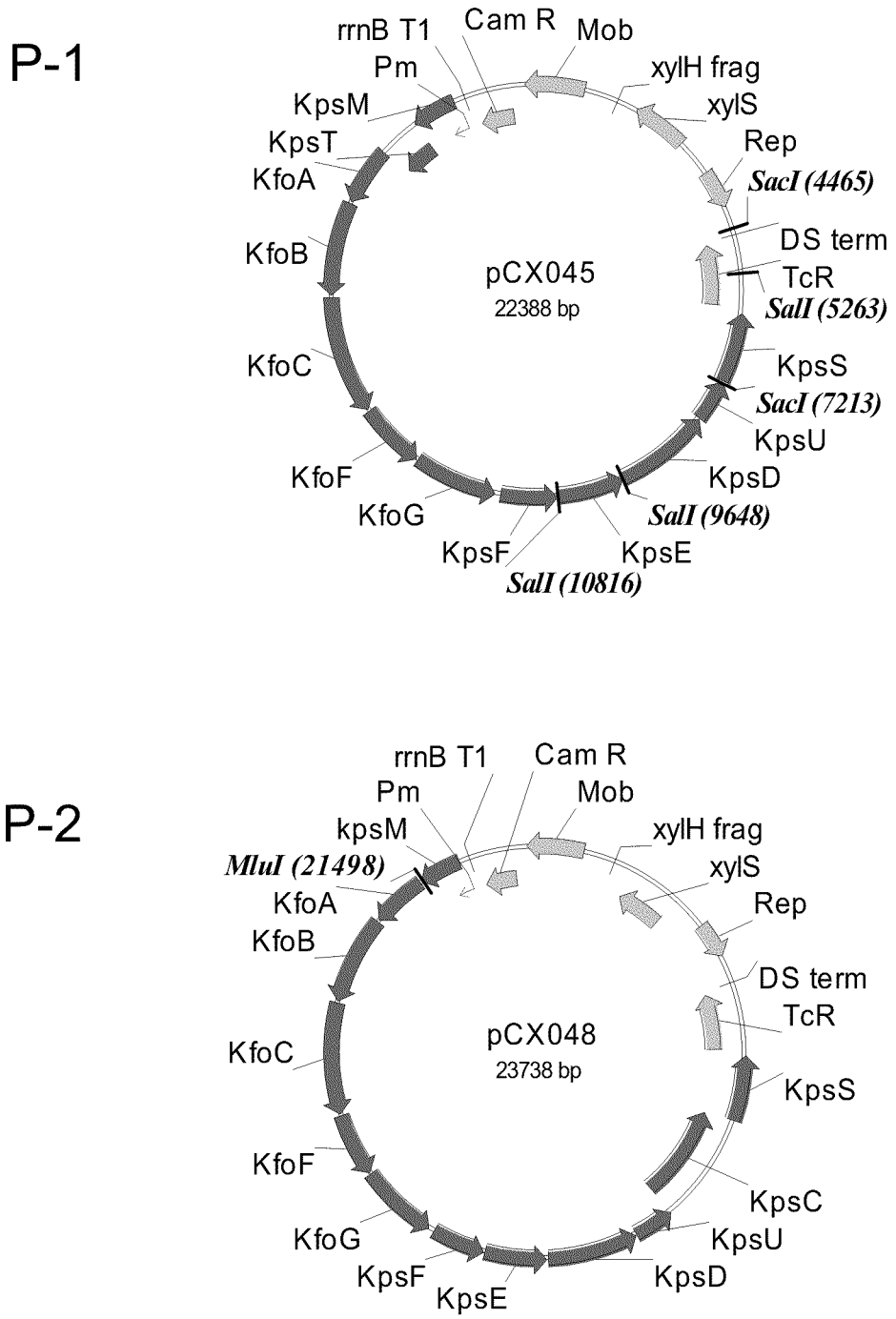

Deletion derivatives of the pDD66 and pDD67 expression plasmids were constructed in order to evaluate the roles of individual genes or groups of genes. Construction of these derivatives utilized the flanking restriction enzyme sites designed into the synthetic K4 gene fragments as described above. The kpsC gene (K4 region 1) was deleted from pDD66 by digestion of 0.6 µg DNA with 10 U SacI for 2 hours in a 10 µL reaction followed by heat treatment of the reaction (to inactivate the enzyme) and ligation (with 1 mM ATP plus T4 DNA ligase) in a 12 µL reaction. Half of this reaction was transformed into E. coli DH5α (Invitrogen) with plating to LB Tc5 at 30° C. In pDD66, the kpsC gene is flanked by SacI sites, but there is also a third SacI site in the vector such that digestion results in a third fragment containing the tetR gene but not the plasmid origin of replication. Therefore, TcR transformants were expected to contain plasmids comprised of at least the vector/origin fragment plus the tetR fragment. Transformants were screened for plasmids containing these two SacI fragments but lacking the kpsC SacI fragment, and candidate pDD66ΔkpsC clones were further screened by SalI digestion for those with the desired orientation of the former two SacI fragments. One such plasmid was named pCX045 (FIG. 8P).

The kpsT gene (K4 region 3) in pDD66 is flanked by MluI restriction sites and there are no other MluI sites in the plasmid. Using steps similar to those described above, pDD66 was digested with MluI followed by re-ligation to generate a pDD66ΔkpsT derivative that was named pCX048. (FIG. 8P)

Plasmid pCX039 was created from pDD67 (described above, see FIG. 8J) by deletion of the K4 regions 1 and 3 genes. Plasmid pDD67 (1.5 µg) was digested simultaneously with enzymes PmlI and MluI (10 U each), followed by treatment with T4 DNA polymerase (1.5 U) plus dNTPs (150 µM each) at 12° C. for 15 min. to fill in the overhangs (leaving blunt ends) generated by MluI. PmlI digestion leaves blunt ends. Treated pDD67 was subsequently incubated with T4 DNA ligase and transformed into E. coli TOP10 (Invitrogen) followed by selection for Tet-resistance and screening for Cm-resistance. Colony PCR on 48 double antibiotic resistant colonies was performed with primers DHD229 and DHD231.

```
DHD229
                                        (SEQ ID NO: 81)
AAGGCGACAAGGTGCTGATG

DHD231
                                        (SEQ ID NO: 82)
CAATGCGACGGATGCTTTCG
```

Figure 8Q:
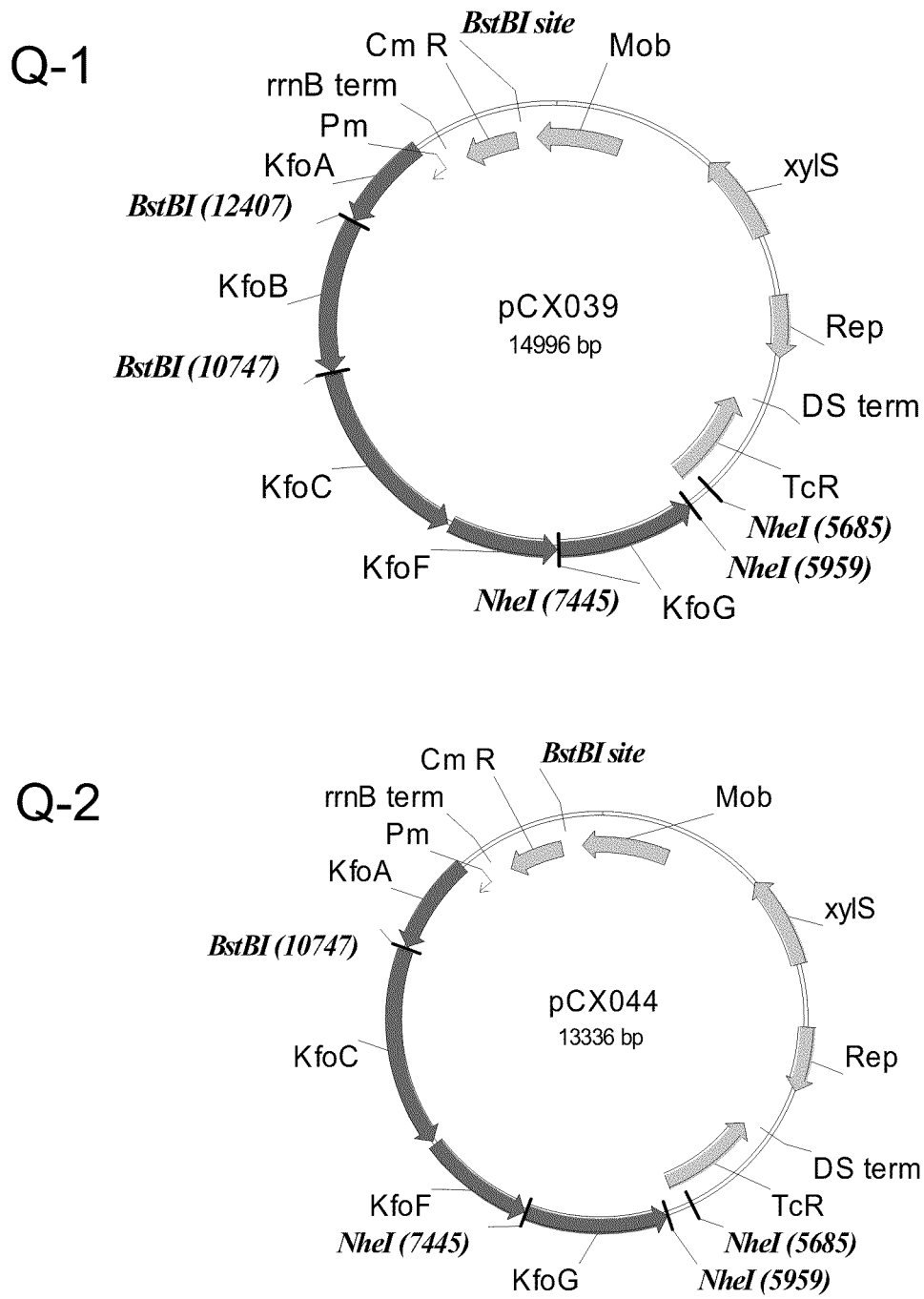

Fourteen of the 48 isolates yielded PCR products approximating the 678 bp expected for the desired construct as determined by agarose gel electrophoresis. The plasmids in six of eight selected candidates were of expected size (by agarose gel electrophoresis), and two chosen plasmid isolates contained the desired DNA sequence at the PmlI/MluI junction. One plasmid was named pCX039 (FIG. 8Q). It contains xylS plus the K4 region 2 genes kfoABCFG driven by the Pm promoter.

The kfoB gene in pCX039 (plus its ribosome binding site) is closely flanked by BstBI restriction sites, and there is a third BstBI site in the vector backbone. Therefore, digestion of pCX039 with BstBI results in three fragments: the kfoB gene fragment, a large fragment encompassing the plasmid replication origin, the Tet-resistance gene, and the kfoCFG genes, and a fragment containing the Cm-resistance gene plus Pm/kfoA (see FIG. 8Q). To create a derivative of pCX039 lacking the kfoB gene, plasmid (600 ng) was completely digested with BstBI (10 U) for 90 min. at 65° C. The enzyme was removed from the reaction with the MinElute kit (QIAGEN) with a final elution in 12 μL Elution Buffer. Approximately 250 ng (5 μL) of this digest was incubated with T4 DNA ligase and transformed into E. coli DH5α (Invitrogen) with selection for Cm-resistance. By selecting for Cm-resistance, plasmids containing at least the large vector fragment (i.e., kfoCFG/origin) plus the Cm/Pm/kfoA fragment should be obtained. Plasmids in 8 selected transformants were analyzed by restriction digests, and 5 were found to be lacking the kfoB BstBI fragment and to have the other two fragments in the desired relative orientation. The plasmid in one such isolate was named pCX044 (FIG. 8Q; xylS plus kfoACFG). One skilled in the art will recognize that an identical plasmid structure could be obtained by partial plasmid digestion with BstBI enzyme.

Figure 8R:
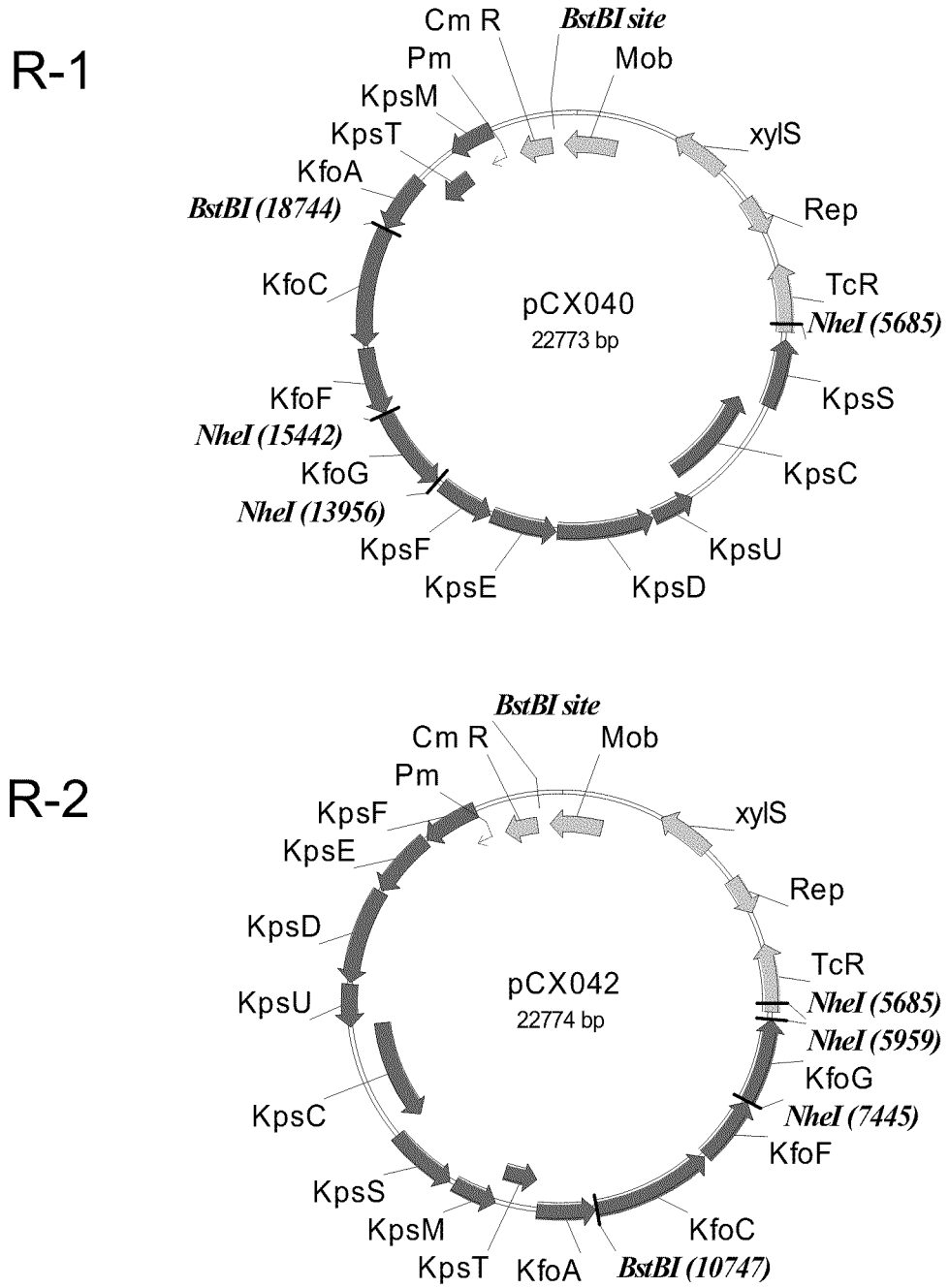

As described above in this Example, plasmids pDD66 and pDD67 contain 13 K4 genes in different arrangements: pDD66-Pm/kpsMT/kfoABCFG/kpsFEDUCS; pDD67-Pm/kpsFEDUCS/kpsMT/kfoABCFG. Most of the K4 genes (together with their respective ribosome binding sites) in these plasmids are closely flanked by pairs of restriction enzyme sites that cut only two or three times within the plasmids. These features (and other sequence elements described above) allow for selective, non-polar deletion of individual K4 genes. Using the steps described above for the creation of pCX044 from pCX039, ΔkfoB derivatives of pDD66 and pDD67 were generated, and these plasmids, depicted in FIG. 8R, were designated pCX040, and pCX042, respectively. The kfoG genes in pDD66 and pDD67 are closely flanked by NheI restriction sites, but in each plasmid there is a third NheI site in the coding region for the tetracycline resistance gene. For generation of ΔkfoG derivatives of pDD66 and pDD67, an approach analogous to that for the generation of the ΔkfoB derivatives was utilized: complete digestion with NheI, ligation, and selection for Tet-resistant transformants of E. coli. This approach selects for regeneration of the tetracycline resistance gene along with the plasmid replication origin. Plasmids in resulting transformants were screened for absence of the kfoG NheI fragment, and pCX041 (pDD66 ΔkfoG) and pCX043 (pDD67 ΔkfoG) were identified and are shown in FIG. 8S. One skilled in the art will recognize that identical plasmid structures could be obtained by partial plasmid digestion with BstBI or NheI enzymes.

Example 5

Antibodies that Recognize K4 Capsule Biosynthesis Proteins

Production of antibodies: Antibodies directed against 15 of the proteins that are encoded by the K4 chondroitin biosynthetic gene cluster were produced as described below. These antibodies can be used to assess expression of the cloned K4 chondroitin biosynthetic genes in the alternative hosts and in the native E. coli K4 strains. They can also be used to assess region 1 and region 3 gene expression in other group 2 capsule producing E. coli and potentially used with other serogroup K4 E. coli to assess region 2 gene expression. Antibodies were generated as follows.

PCR primers were designed to amplify a series of polypeptides, or complete proteins, on the order of about 20-30 kDa each in size, corresponding to the 17 genes identified in the K4 capsule gene cluster. The initial set of PCR primers were based on the sequence of the U1-41 K4 capsule gene cluster as determined in Example 1. In some instances, cloned PCR fragments were sequence-verified and then subcloned into pQE30 (Qiagen, Inc., Valencia, Calif.), an E. coli plasmid vector, for high level expression in E. coli. Alternatively, PCR fragments were cloned directly into the expression vector and then sequenced. The pQE30 vector employs a strong bacteriophage T5 promoter under control of the LacI repressor protein to achieve high levels of IPTG inducible expression in E. coli. The vector is designed to fuse a poly-His tag at the amino-terminus of the cloned polypeptide in order to facilitate purification. Initially, antigens derived from KpsM, KpsF, KpsE, KpsS, KfoC, KfoH and KfoC were expressed in the pQE30 vector as His-tagged polypeptides and antigens derived from KpsD, KpsU, KpsC, KfoD, KfoI, KfoE and KfoF were expressed without the His-tag. The constructs lacking the His tag were created by cloning into a derivative of pQE30, termed pQE30-dH, in which the sequence encoding the His residues was deleted. Subsequent expression experiments indicated that the His tag was required for efficient expression of the polypeptide antigens derived from KfoC, KfoH and KfoG, but that other antigens were efficiently expressed in pQE30-dH as non-tagged forms. Therefore, most antigens were expressed in the non-tagged forms in order to avoid the possibility of obtaining antisera that recognized an epitope present on the injected antigen but not present in the native target protein.

For expression of antigens, cultures containing antigen sequences cloned into pQE30 or pQE30-dH typically were grown at 37° C. in Luria Broth to mid-log phase, and then induced by the addition of 1 mM IPTG. Typically, 4 hours post-induction, cells were harvested and fractionated into soluble and insoluble fractions using BugBuster® Protein Extraction Reagent (Novagen, Madison, Wis.), a detergent-based lysis system, according to the vendor protocols. Typically, over-expression in the T5 promoter system leads to accumulation of the expressed polypeptide in an insoluble form within the E. coli cytoplasm although some expressed polypeptides are accumulated in a soluble form. The KpsU-derived antigen was expressed in a soluble form; all other antigens were found to partition to the insoluble fraction. Often, the recombinant protein is the predominant polypeptide in the insoluble fraction generated by the BugBuster® lysis and extraction procedure. For immunization purposes, expression of these polypeptide antigens was performed in 100 ml shake-flask cultures. Following lysis of induced cultures, insoluble fractions of all cultures (except the KpsU antigen-expressing culture) were run on preparative gels. In the case of KpsU antigen, the polypeptide antigen partitioned to the soluble fraction of the cell lysate and therefore that soluble fraction was run on preparative gels. The gel regions containing the protein of interest were excised and sent to the commercial vendor, Open Biosystems (Huntsville, Ala.) for further processing and subsequent immunization of rabbits to produce antisera.

In the initial experiments, 12 antigens were deemed to be sufficiently well expressed to warrant purification of the antigen. These 12 antigens were derived from KpsE, KpsD, KpsU, KpsC, KpsS, KpsT, KfoA, KfoB, KfoI (Orf3), KfoE, KfoH (Orf1) and KfoF. Antigens derived from the protein sequences of KpsF, KpsM, KfoC, KfoD, and KfoG were not expressed or were poorly expressed. The polypeptide sequences of poorly expressed antigens were analyzed with respect to codon usage, and physical properties such as hydrophobicity and calculated pI. Comparison to these same properties as determined for the well-expressed polypeptide antigens did not reveal any clear correlations. Codon usage was unfavorable in some poorly expressed antigens, such as KfoG, but it was also unfavorable in other well-expressed antigens. The KpsM antigen was extremely hydrophobic and that could potentially affect stability of the expressed antigen, but because KpsM is an integral membrane protein, its entire sequence is very hydrophobic and any polypeptide of significant size derived from KpsM will be highly hydrophobic.

Additional antigen coding sequences were derived from the synthetic, codon-optimized, genes for KpsM, KpsF, KfoC, and KfoG using the synthetic K4 gene set described above in Example 2. PCR products derived from the synthetic DNA template were cloned into pQE-30, the 6×-His tag vector, and tested for expression. Synthetic sequence KfoC, KfoG, and KpsF antigens were found to have high, or moderately high, accumulation when expressed in the pQE-30 vector with a 6×-His tag. These antigens were gel-purified from induced cultures as described above and sent to Open Biosystems (Huntsville, Ala.) for antisera production in rabbits. Synthetic sequence KpsM antigen with a 6×-His tag was not expressed at detectable levels as determined by Coomassie staining of induced cultures.

Antisera from immune rabbits were tested by western blot for titer and for specificity using cell extracts from induced antigen-expressing E coli strains. All antisera recognized their respective antigens in these western blots. Titers for use were typically 1:1500 with acceptable non-specific background. Examples of results from western blots performed using these antisera are shown in FIG. 9.

Figure 9:
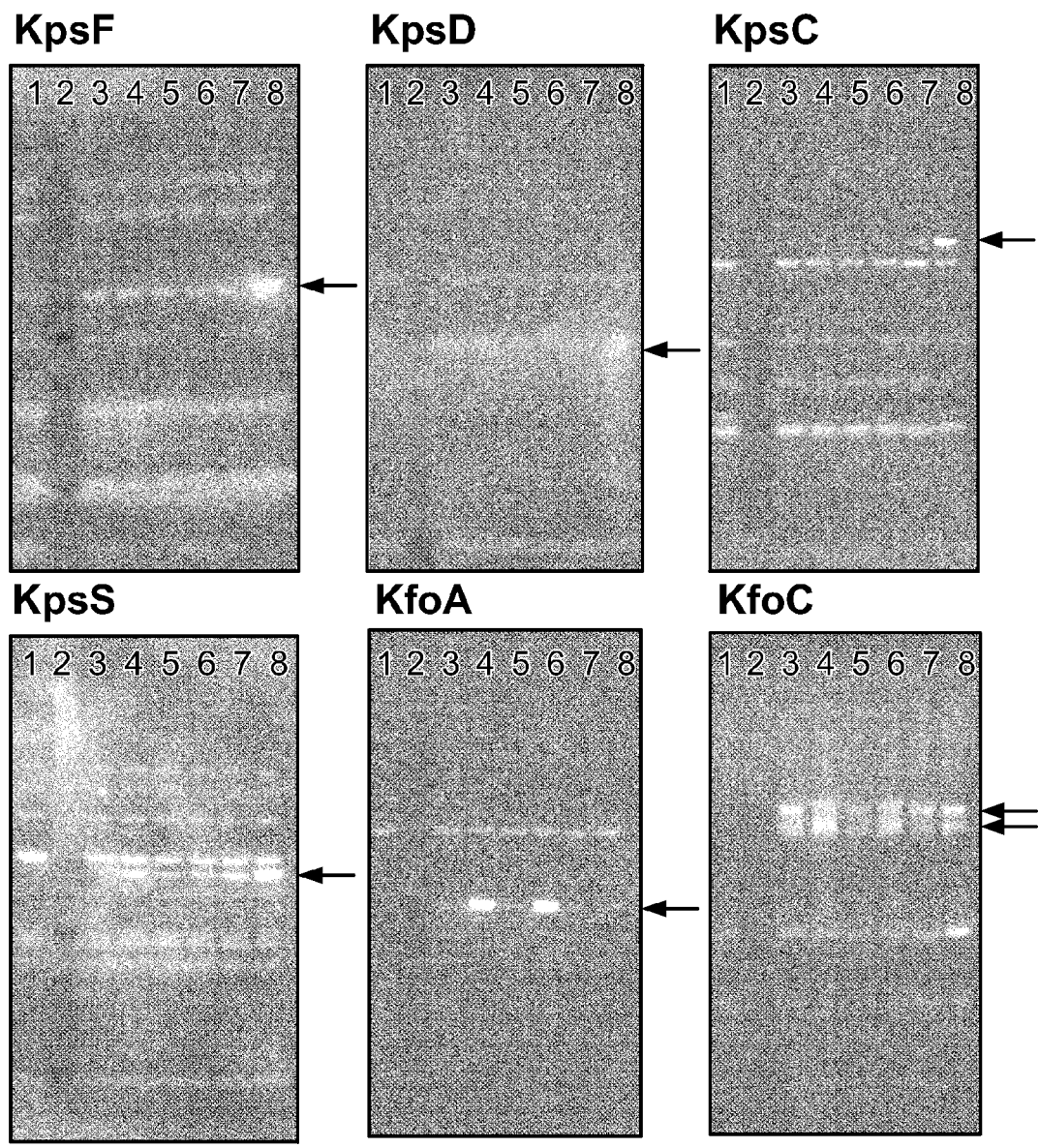
FIG. 9 shows examples of results from western blots performed using antisera directed against proteins encoded by the *E. coli* K4 group 2 capsule gene cluster with analysis of expression of KpsF, KpsD, KpsC, KpsS, KfoA and KfoC in *E.coli* K-12. 50 mL cultures were grown in 250 mL shake flasks at 30° C. in TB medium plus 5 µg/mL tetracycline. Aliqouts of each culture were induced with 1 mM m-TA at ~0.1 OD A600. Cultures were harvested at 24 hours post-induction and analyzed by western blots using antisera directed against individual proteins as designated above each panel. Arrows indicate the reacting band(s) identified as specific to the target protein. Samples run in each lane are as follows: (1) MSC278=MSC188+pDD63 (empty vector); (2) molecular weight marker; (3) MSC274=MSC175+pDD62 (uninduced); (4) MSC274=MSC175+pDD62 (+m-TA); (5) MSC279=MSC188+pDD66 (uninduced); (6) MSC279=MSC188+pDD66 (+m-TA); (7) MSC280=MSC188+pDD67 (uninduced); (8) MSC280=MSC188+pDD67 (+m-TA).

As shown in FIG. 9, some antisera (e.g. anti-KfoA, anti-KpsD and anti-KpsS) identified the target protein band in strains carrying the cloned K4 genes with little or no observable non-specific reactivity to other E. coli proteins. In other antisera (e.g. anti-KpsC and anti-KpsF) more non-specific binding was observed, but the target proteins could be clearly identified by comparison to E. coli control strains lacking the cloned K4 genes. Most antisera identified single protein bands as their specific targets in western blots, but in some instances (e.g. KfoC) multiple bands were specifically recognized The KfoC polypeptide appeared to undergo some proteolyic breakdown or processing either intracellularly or during processing of extracts prior to the western blot, and a doublet band, as indicated in FIG. 9, was consistently observed.

Thus, antisera that could detect KpsF, KpsE, KpsD, KpsU, KpsC, KpsS, KpsT, KfoA, KfoB, KfoC, KfoI (Orf3), KfoE, KfoH (Orf1), KfoF and KfoG in E. coli K4 strains, and in recombinant strains expressing the cloned K4 capsule gene cluster, and in native E. coli strains that might contain some or all of these genes were successfully raised.

The amino acid sequence of the recombinantly-expressed polypeptide that was used to immunize rabbits to generate antisera that recognized the indicated proteins is given below. The antigens that were expressed in the pQE30-dH vector contain an added MGS sequence at the amino-terminus of the expressed polypeptide which is derived from the plasmid expression vector and is not present in the sequence of the target protein. Antigens that were expressed in the pQE30 vector by cloning into the BamHI site contain an added MRG-SHHHHHHGS (amino acids 1-12 of SEQ ID NO: 85) sequence at the amino-terminus which is derived from the plasmid expression vector and is not present in the target protein. Antigens that were expressed in the pQE30 vector by cloning into the SacI site contain an added MRGSHHHHH-HGSACEL (amino acids 1-16 of SEQ ID NO: 93) sequence at the amino-terminus which is derived from the plasmid expression vector and is not present in the target protein. The amino-terminal sequences of the polypeptide antigens that are derived from the expression vector DNA sequences are shaded below.

```
(SEQ ID NO: 83):

KfoA-derived antigen
MGSLNKGYNVVIIDNLINSSCESIRRIELIAKKKVTFYELNINNEKEVNQ
ILKKHKFDCIMHFAGAKSVAESLIKPIFYYDNNVSGTLQLINCAIKNDVA
NFIFSSSATVYGESKIMPVTEDCHIGGTLNPYGTSKYISELMIRDIAKKY
SDTNFLCLRYFNPTGAHESGMIGESPADIPSNLVPYILQVAMGKLEKLMV
FGGDYPTKDGT (SEQ ID NO: 84):

KfoB-derived antigen
MGSWLAYNTALLHFFLNNRGRCLLVSSEQVKRNAEDCIQQLQHKLKLKFG
LSFSNTINHSLEQSVNDFKTAEASITLEKEHQEIMSLSGIDIGTGDIIFK
QSETEEYLIFNVLNDYPDCKELYFELQSNANTPLRVLEKENYKPSFIWET
FIKQRQITLDIVNGLYQSSKKIILDNELHTSKQLNAYQAILKELSDSKEE
LIQYDLIIKNKTIQVQELEC (SEQ ID NO: 85):

KfoC-derived antigen
MRGSHHHHHHGSAISLNEVEKNEIISKYREITAKKSERAELKEVEPIPLD
WPSDLTLPPLPESTNDYVWAGKRKELDDYPRKQLIIDGLSIVIPTYNRAK
ILAITLACLCNQKTIYDYEVIVADDGSKENIEEIVREFESLLNIKYVRQK
DYGYQLCAVRNLGLRAAKYNYVAILDCDMKLN (SEQ ID NO: 86):

KfoI (Orf3)-derived antigen
MGSVDLDNTISFNLSGKYSHATPNKKLIEKLYEYKLNGFYIVIFTARNMR
TYKENIGKINIHTLPVIIDWLNENRVPYDEVIVGKPWCGDEGFYVDDRAI
RPSELCNMTLEEISNMLEQEKKCF (SEQ ID NO: 87):

KfoE-derived antigen
MGSPEDFVFDKHDYEWLLRNKVTMIPVDSNLTLGQAIVTAWNLIGDKDDK
GLQLLFGDTLFKKIPAGDDLVAISHSDDNYQWSFFYETELRAVSREDNKN
VICGYFSFSKPNFFIRELVTSKFDFTAALKKYHDSYSLASIYVSDWLDFG
HINTYYKSKVQYTTQRAFNELCITTKSVIKSSSNESKIEAESKWFETIP
```

(SEQ ID NO: 88):

KfoH (Orf1)-derived antigen

MRGSHHHHHHGSASLGINSYTLITLDKETRGQAETVYLAISKLFNIEQPI
TIFNIDTIRPNFIFTKFEGENECYIEVFRGDGDNWSFVMPSNDVKNEVIA
TSEKKQISNLCCTGLYHFSTIKNFISAYEHYKNLPQENWDAGELYIAPIY
NYLISNGIKVYYTEINKSDVIFCGTPREYENLQG (SEQ ID NO: 89):

KfoF-derived antigen

MGSVGFTERLKRDLNTNNIIFSPEFLREGKALYDNLYPSRIVVGESSERA
RKFAELLSEGAIKKDIPILLTDSPEAEAIKLFANTYLAMRIAYFNELDTY
ASVHGLDTKQIIEGVSLDPRIGQHYNNPSFGYGGYCLPKDTKQLLANYRD
VPQNLIQAIVDANTTRKDFVAEDILSRKPKVVGIYRLIMKAGSDN (SEQ ID NO: 90):

KfoG-derived antigen

MRGSHHHHHHGSDDTLFRLQRLALKDTRIKIISLPQNVGTYAAKRIGLIQ
AKGEFVTCHDSDDWSHPEKLFRQISPLLLNPKLICSISDWVRLQDNGIFY
ARAVYPLKRLNPSSLLFRRADVLQKAGVWDCVKTGADSEFIARLKLIFGD
STVHRIKLPLTLGSHRTDSLMNSPTTGYTSQGISPDRQKYWDSWSRWHIQ
ALRNKESLYIGNSDFTNKNRPFSAPDSILVDTNAIKTALQSAHVNFT (SEQ ID NO: 91):

KpsT-derived antigen

MGSMIKIENLTKSYRTPVGRHYVFKNLNIEIPSGKSVAFIGRNGAGKSTL
LRMIGGIDRPDSGKIITNKTISWPVGLAGGFQGSLTGRENVKFVARLYAK
QEELKEKIEFVEEFABLGKYPDMPIKTYSSGMRSRLGFGLSMAFKFDYYI
VDEVTAVGDARFKEKCAQLFKERHKESSFLMVSHSLNSLKEFCDVAIVFK
DDNAVSFHEDVQEGIEEYITEQNNY (SEQ ID NO: 92):

KpsF-derived antigen

MRGSHHHHHHGSLAIAMIHQRKFMPNDFARYHPGGSLGRRLLTRVADVMQ
HDVPAVQLDASFKTVIQRITSGCQGMVMVEDAEGGLAGIITDGDLRRFME
KEDSLTSATAAQMMTREPLTLPEDTMIIEAEEKMQKHRVSTLLVTNKANK
VTGLVRIFD (SEQ ID NO: 93):

KpsE-derived antigen

MRGSHHHHHHGSACELPEFALKFNQTVLKESERFINEMSHRIARDQLAFA
ETEMEKARQRLDASKAELLSYQDNNNVLDPQAQAQAASTLVNTLMGQKIQ
MEADLRNLLTYLREDAPQVVSARNAIQSLQAQIDEEKSKITAPQGDKLNR
MAVDFEEIKSKVEFNTELYKLTLTSIEKTRVEAARKLK (SEQ ID NO: 94):

KpsD-derived antigen

MGSLNYLIKAGGVDPERGSYVDIVVKRGNRVRSNVNLYDFLLNGKLGLSQ
FADGDTIIVGPRQHTFSVQGDVFNSYDFEFRESSIPVTEALSWARPKPGA
THITIMRKQGLQKRSEYYPISSAPGRMLQNGDTLIVSTDRYAGTIQVRVE
GAHSGEHAMVLPYGSTMRAVLEKVRPNSMSQMNAVQLYRPSVAQRQKEML
NLSLQKLEEASLSAQSSTKEEAS (SEQ ID NO: 95):

KpsU-derived antigen

MGSMSKAVIVIPARYGSSRLPGKPLLDIVGKPMIQHVYERALQVAGVAEV
WVATDDPRVEQAVQAFGGKAIMTRNDHESGTDRLVEVMHKVEADIYINLQ
GDEPMIRPRDVETLLQGMRDDPALPVATLCHAISAAEAAEPSTVKVVVNT
RQDALYFSRSPIPYPRNAEKARYLKHVGIYAYRRDVLQNYSQLPESMPEQ
AESLEQLRLMSAGINIRTFEVAATGPGVDTPACLEKVRALMAQELAENA (SEQ ID NO: 96)

KpsC-derived antigen

MGSQRVRLIAENVSPQSLLRHVSRVYVVTSQYGFEALLAGKPVTCFGQPW
YAGWGLTDDRHPQSALLSARRGSATLEELFAAAYLRYCRYIDPQTGEVSA
LFTVLQWLQLQRRHLQQRNGYLWVPGLTLWKSAILKPFLQTATNRLSFSR
RCTAASACVVWGVKGEQQWRAEAQRKSLPLWRMEDGFLRSSGLGSDLLPP
LSLVLDKRGIYYDATRPSELEVLLNHSQLTLAHQMRAEKLRQRLVESKLS
KYNLGA (SEQ ID NO: 97):

KpsS-derived antigen

MRGSHHHHHHGSACELCFGDCRLLHKEAKRWAKSKGIRFLAFEEGYLRPQ
FITVEEGGVNAYSSLPRDPDFYRKLPDMPTPHVENLKPSTMKRIGHAMWY
YLMGWHYRHEFPRYRHHKSFSPWYEARCWVRAYWRKQLYKVTQRKVLPRL
MNELDQRYYLAVLQVYNDSQIRNHSNYNDVRDYINEVMYSFSRKAPKESY
LVIKHHPMDRGHRLYRPLIKRLSKEYGLDERVIYVHDLPMPELLRHASLI
S

Example 6

The Synthetic Gene Set [kpsFEDUCS+kpsMT+kfoAB-CDIEHFG] Produces Fructosylated Chondroitin when Expressed in E. coli K-12

Plasmids pDD54 and pDD58, described in Example 4 above, were transformed into MSC188 (*E. coli* K-12 strain W3110 deleted for the colanic acid biosynthetic gene cluster as described above in Example 3). The resulting strains, MSC204 [MSC188 (pDD54)] and MSC206 [MSC188 (pDD58)], were grown in shake flask cultures and tested for chondroitin production. Strains were grown overnight from fresh colonies in CYG medium (20 g/L casamino acids, 5 g/L yeast extract, 2 g/L glucose, pH 7.2) plus chloramphenicol (20 µg/mL) at 30° C. and these cultures were diluted to OD A600=0.05 in the same medium. At OD A600 of approximately 0.1 (after approximately 1 hour), the inducer m-toluic acid was added to a final concentration of 2 mM. At 4, 8, and 24 hours post-induction, OD A600 values were determined and samples were taken for analysis. Culture ODs are given in Table 6-1 below. For each strain at each time point, 10 mL samples for polysaccharide analysis were autoclaved (121° C., >15 psi, 5 min.) then stored frozen. Two 5 ml aliquots of each strain at each time point were centrifuged and resulting cell pellets were stored frozen for subsequent western blot analyses.

As shown in Table 4A, the *E. coli* K-12 strains, MSC204 and MSC206, grew well after induction; at 24 hours post-induction the ODs of both of these cultures were approximately 7. Culture samples from these experiments were assayed using the HPLC-based, chondroitinase-dependent assay for chondroitin and fructosylated chondroitin, as described in detail in Example 14. Culture samples were subjected to the defructosylation step (acid treatment) prior to enzymatic digestion in these assays. Culture samples also were assayed by an ELISA assay that is specific for fructosylated chondroitin (Example 14). Assay results are shown in Table 4A.

TABLE 4A

Growth and chondroitin production in strains MSC204 and MSC206.

| Strain | time[a] | OD A600 | ELISA assay chondroitin µg/mL | HPLC assay[b] chondroitin µg/mL |
|---|---|---|---|---|
| MSC204 | 4 hr | 1.56 | 0.0 | n.d.[c] |
| MSC204 | 8 hr | 2.58 | 0.0 | n.d. |
| MSC204 | 24 hr | 6.65 | 0.0 | 0 |
| MSC206 | 4 hr | 1.38 | 1.2 | 4.5 |
| MSC206 | 8 hr | 2.57 | 1.1 | 10.1 |
| MSC206 | 24 hr | 7.14 | 27.9 | 25.0 |

[a]post-induction
[b]defructosylation step included in assay
[c]not determined

These results clearly demonstrate that recombinant *E. coli* K-12 carrying pDD58 (strain MSC206) produces fructosylated chondroitin. The detection of the polysaccharide by ELISA demonstrates that the recombinant polysaccharide produced in these strains is fructosylated chondroitin because the antiserum used in the ELISA assay is specific for the fructosylated form of chondroitin and does not recognize unfructosylated chondroitin. The highest level of fructosylated chondroitin production observed in this experiment was approximately 25 µg/mL. Fructosylated chondroitin production was consistently undetectable in the control strain MSC204 that carried the vector-only plasmid, pDD54. There are quantitative differences in fructosylated chondroitin values measured between the ELISA and the HPLC assays for the MSC206 at 4 hr and 8 hr samples. These differences probably reflect the lower sensitivity of the ELISA assay. Typically, the higher the fructosylated chondroitin concentration in a given sample, the closer is the agreement between the ELISA and the HPLC assays.

A subsequent experiment was performed to confirm the production of fructosylated chondroitin by MSC206 and to test the effect of inducer concentration on level of chondroitin produced. A fresh overnight culture of MSC206 was diluted to 0.05 OD A600 and grown at 30° C. in CYG medium plus chloramphenicol (20 μg/mL) to an OD A600 of approximately 0.1. Aliquots of the culture were then induced by addition of m-toluic acid to a final concentration of 0, 0.5, 1.0, or 2.0 mM. Cultures were grown for 24 hours post-induction at which point ODs were measured and samples were taken as described above for polysaccharide assays. Also at 24 hours post-induction, aliquots of each culture were diluted and plated on LB to quantitate total viable cells and on LB plus chloramphenicol (17 μg/mL) to quantitate plasmid-containing viable cells. Growth and chondroitin production of these cultures are summarized in Table 4B.

TABLE 4B

Effect of inducer concentration on growth and chondroitin production in MSC206.

| Inducer concentration | 0 | 0.5 mM | 1.0 mM | 2.0 mM |
| --- | --- | --- | --- | --- |
| OD A600 at 24 hr | 3.08 | 2.99 | 2.91 | 2.29 |
| cfu/mL LB | $1.77 \times 10^9$ | $2.35 \times 10^9$ | $1.77 \times 10^9$ | $0.81 \times 10^9$ |
| cfu/mL LB + $Cm^{17}$ | $6.55 \times 10^8$ | $6.58 \times 10^8$ | $5.66 \times 10^8$ | $3.00 \times 10^8$ |
| % Cm-resistant | 27% | 28% | 32% | 37% |
| ELISA assay: chondroitin | 7.4 μg/mL | 22.3 μg/mL | 30.5 μg/mL | 12.3 μg/mL |
| HPLC assay*: chondroitin | 9.7 μg/mL | 25.1 μg/mL | 31.1 μg/mL | 17.5 μg/mL |

*defructosylation step included in assay

As shown in Table 4B, in this experiment, only the highest level of inducer had a negative effect on growth and viable cell numbers at 24 hours. In this experiment, the expression plasmid, pDD58, was not stably maintained, even though the strain was grown in the presence of the selective antibiotic, chloramphenicol. There appears to be significant loss of plasmid at the 24 hour time point as evidenced by lower titers of colony-forming-units obtained when samples were plated on LB+$Cm^{17}$ plates as compared to LB plates. However, the fraction of plasmid-containing cells was not affected significantly by inducer concentration. Results of the ELISA assay confirm production of fructosylated chondroitin in MSC206 and are consistent with the results obtained using the HPLC assay when the de-fructosylation step is included. The samples with the highest chondroitin titers showed the best agreement between ELISA and HPLC assays. These results also demonstrate the production of fructosylated chondroitin even in the absence of induction by m-TA addition. However, all induced cultures produced more fructosylated chondroitin than the uninduced culture, with the highest level of fructosylated chondroitin being produced by the culture that was induced with 1.0 mM m-TA.

Example 7

Expression of Gene Set [kpsFEDUCS+kpsMT+kfoABCFG] Produces Unfructosylated Chondroitin when Expressed in *E. coli* K-12 or *E. coli* B. The kfoB and kfoG Genes are not Essential for Production of Unfructosylated Chondroitin, but kfoG is Required for Optimal Production Prior to this work, the genes that encode proteins responsible for fructosylation of the K4 capsular polysaccharide had not been identified. No function had been identified for the proteins encoded by many of the genes present in region 2 of the K4 capsule gene cluster: kfoB, kfoG, kfoD, kfoE, kfoH (orf1) and kfoI (orf3).

The genes present within region 2 of group 2 *E. coli* capsules are all typically involved in synthesis of the polysaccharide or the sugar nucleotide precursors of the polysaccharide (Whitfield 2006). As noted above (Example 1), the kfoB and kfoG genes encode proteins that are homologous to those encoded by genes present in capsule clusters of bacteria known to produce other glycosaminoglycan capsules. This circumstantial evidence suggests a potential role for kfoB and kfoG in biosynthesis of glycosaminoglycan capsules. In contrast, prior to the present invention, no evidence implicated kfoD, kfoI, kfoE and kfoH genes as being involved in biosynthesis of the chondroitin backbone of the K4 capsular polysaccharide. The present inventors hypothesized that the kfoD, kfoI, kfoE and kfoH genes might encode proteins that are involved in fructosylation of chondroitin although others have hypothesized that the kfoD and kfoE genes were probably not involved in fructosylation (Ninomiya et al., 2002 and Krahulec et al., *Molec. Biotech.*, 2005; 30:129-134.). To test that hypothesis, recombinant plasmids were constructed that did not contain the kfoDIEH gene set but did contain kpsFEDUCS, kpsMT and kfoABCFG genes. Two such plasmids, termed pDD66 and pDD67, were constructed as described in Example 4 above. These two plasmids also contain a gene conferring tetracycline resistance, so that tetracycline can be used in cell cultures to select for plasmid maintenance. A derivative of pDD58, termed pDD62, was also constructed as a control plasmid. The pDD62 plasmid, described in detail in Example 4 above, contains kpsFEDUCS, kpsMT and kfoAB-CDIEHFG genes and also contains a gene that confers resistance to tetracycline.

To determine if deletion of the kfoDIEH genes affected biosynthesis of the fructosylated chondroitin, pDD62, pDD66 and pDD67 were transformed into MSC188 or MSC175 (W3110ΔwcaJ described in Example 3 above) and the resulting strains were cultured and assayed for production of fructosylated chondroitin and unfructosylated chondroitin. Strains MSC274 (MSC175+pDD62), MSC279 (MSC188+pDD66) and MSC280 (MSC188+pDD67) were grown in CYG medium in shake flasks at 30° C. with 2 μg/mL tetracycline (Tc) and induced with 1 mM m-TA as indicated. Cultures were sampled at 24 hours post-induction as described above, autoclaved, centrifuged and the resulting supernatants were assayed by the HPLC assay with, or without, a de-fructosylation step.

As shown in Table 5A below, all strains produced chondroitin, but the chondroitin polysaccharide produced by strains containing plasmids pDD66 or pDD67 shows no evidence of fructosylation. That is, the chondroitin titers measured by HPLC for MSC279 and MSC280 samples are not significantly different for the samples subjected to the de-fructosylation step sample as compared to the samples that were not subjected to the de-fructosylation step. In contrast, very little chondroitin is observed when the MSC274 sample is assayed without the de-fructosylation step. Significant chondroitin is only detected in the MSC274 sample that was subjected to the de-fructosylation step. As detailed in Example 14, fructosylated chondroitin is not digested by the chondroitinase that is used in the HPLC assay, and is therefore not detectable by this assay. These data clearly demonstrate that one or more of the kfoDIEH genes must be required for fructosylation of chondroitin, but none of these genes is required for chondroitin biosynthesis. These results again demonstrate that chondroitin is produced in the absence of induction by m-TA, but that the induced cultures produced more chondroitin than the uninduced cultures. Surprisingly, the titers of non-fructosylated chondroitin produced by both MSC279 and MSC280 are greater (2.5- to 4-fold), than titer of fructosylated chondroitin produced by MSC274. This result suggests that the fructosylation event reduces the efficiency of chondroitin production. This is consistent with the observation that in vitro, fructosylated chondroitin is a poor substrate for the KfoC enzyme (chondroitin polymerase) as compared to unfructosylated chondroitin (Lidholt and Fjelstad, *J. Biol. Chem.* 1997; 272:2682-2687).

TABLE 5A

Production of unfructosylated chondroitin in *E. coli* K-12.

| Strain | m-TA | OD A600 at 24 hr | cfu/mL LB | cfu/mL LB + Tc | % Tc$^r$ | chondroitin (μg/mL) +de-fruc.$^a$ | chondroitin (μg/mL) no de-fruc.$^b$ |
|---|---|---|---|---|---|---|---|
| MSC274 | 0 | 2.62 | 1.16 × 10$^9$ | 0.81 × 10$^9$ | 70 | 4.1 | 0.1 |
| MSC274 | 1 mM | 2.76 | 1.39 × 10$^9$ | 0.95 × 10$^9$ | 68 | 15.6 | 0.2 |
| MSC279 | 0 | 2.74 | 1.32 × 10$^9$ | 1.00 × 10$^9$ | 76 | 17.1 | n.d.$^c$ |
| MSC279 | 1 mM | 2.61 | 0.90 × 10$^9$ | 0.86 × 10$^9$ | 96 | 37.1 | 37.7 |
| MSC280 | 0 | 2.72 | 1.43 × 10$^9$ | 0.97 × 10$^9$ | 69 | 15.8 | n.d. |
| MSC280 | 1 mM | 3.03 | 1.48 × 10$^9$ | 1.12 × 10$^9$ | 76 | 54.4 | 59.9 |

$^a$subjected to defructosylation treatment; 80° C. at pH 1.5 for 30 minutes
$^b$not subjected to defructosylation treatment
$^c$not done These strains show improved plasmid retention, i.e., retention of antibiotic resistance, as compared to strain MSC206. See Table 4B in Example 6 above for MSC206 plasmid retention data. This probably reflects the use of tetracycline vs. chloramphenicol for selection of the plasmid. Additional experiments could be performed to optimize the concentration of tetracycline, or other preferred antibiotic, used in order to maximize plasmid retention, without impairing cell growth, to achieve maximal chondroitin production.

Plasmids pDD66 and pDD67 were transformed into MSC139, *E. coli* B (ATCC11303), and the resulting strains were tested for chondroitin production. A control plasmid, pDD63, was also transformed into MSC139. This plasmid, described in Example 4 above, is a derivative of the pDD54 vector to which a tetracycline-resistance gene has been added. It contains none of the K4 chondroitin biosynthesis genes. Chondroitin production in *E. coli* B containing pDD63 (MSC314), pDD66 (MSC315) or pDD67 (MSC316) was evaluated in shake flasks.

In this experiment, cultures were grown in TB medium containing 5 μg/mL tetracycline (Tc$^5$) at 30° C. As described in Example 8 below, growth in TB medium was found to enhance recombinant production of chondroitin in *E. coli* as compared to CYG medium, and Tc$^5$ was found to be an effective concentration for plasmid maintenance without impairing cell growth. The cultures were inoculated at 0.05 OD A600 and induced at 0.10-0.13 by addition of 2 mM m-TA. Following induction, cultures were grown at 30° C. for up to 3 days. Strain MSC315 initially grew slower than the others and was induced several hours later than MSC314 and MSC316 cultures. At 48 hours post-induction (42 hours post-induction in the case of MSC315) samples were taken for viable cell counts in the presence or absence of tetracycline and for chondroitin assays by the HPLC method.

Assay results shown in Table 5B below demonstrate chondroitin production at significant levels in *E. coli* B when either pDD66 or pDD67 is present. No chondroitin was detected in strain MSC314 which contains the pDD63, the "empty vector" control. Plasmid retention (% Tc$^r$) in this experiment was approximately 50% for pDD66 and pDD67 whereas there was no detectable loss of the control vector pDD63.

TABLE 5B

Production of recombinant chondroitin in *E. coli* B.

| Strain | Plasmid | Time P-I | OD A600 | cfu/mL (×10$^8$) | % Tc$^r$ | chondroitin$^a$ (μg/mL) |
|---|---|---|---|---|---|---|
| MSC314 | pDD63 | 48 h | 10.8 | 7.8 | 100 | 0 |
| MSC315 | pDD66 | 42 h | 7.72 | 5.1 | 49 | 394 |
| MSC316 | pDD67 | 48 h | 6.70 | 4.1 | 56 | 280 |

$^a$HPLC method without de-fructosylation treatment

*E. coli* B does not produce a capsule but does contain a cryptic group 2 capsule gene cluster in which the region 2 genes are disrupted by an insertion element, and regions 1 and 3 genes appear functional (Andreishcheva and Vann, *Gene* 2004; 484:113-119). To determine whether the *E. coli* K4 region 2 genes can "complement" the *E. coli* B region 2 defect, a plasmid containing only kfoABCFG genes was constructed. This plasmid, pCX039, is described in Example 4. Plasmid pCX039 was transformed into MSC139, *E. coli* B (ATCC11303), and chondroitin production in the resulting strain, designated MSC317, was evaluated in shake flasks. The strain was grown in TB medium plus 5 μg/mL Tc at 30° C. The culture was inoculated at approximately 0.05 OD A600 and induced with 2 mM m-TA at an OD of approximately 0.10. At 48 hours post-induction, samples were taken for viable cell counts in the presence or absence of tetracycline and for chondroitin assay by the HPLC method.

When assayed on LB plates, 5.9×10$^9$ cfu/mL were obtained and the titer of cfu obtained from parallel platings on LB plates containing 5 μg/mL Tc was not significantly different. This indicates that the pCX039 plasmid was quantitatively retained in this experiment. The HPLC based chondroitin assay was performed without a de-fructosylation step. The chondroitin titer measured in this assay was 205 μg/mL. This result demonstrates that only region 2 K4 genes kfoAB-CFG are required to achieve chondroitin biosynthesis in *E. coli* B. In Example 9 below, the regions 1 and 3 genes in *E. coli* B are shown to function in concert with the K4 region 2 genes to result in chondroitin secretion, a finding consistent with those of Andreishcheva and Vann (2004).

As noted above, KfoB and KfoG homologs are encoded in gene clusters of other glycosaminoglycan-producing bacteria, but the functions of these proteins remain unknown. As described in Example 4, the kfoB or kfoG genes were deleted from pDD66 and pDD67 to generate plasmids pCX040, pCX041, pCX042 and pCX043 which are summarized in Table 5C below. These plasmids were transformed into host strain MSC188 and cultures of the resulting strains were tested for chondroitin biosynthesis. Cultures were grown in TB medium at 30° C., induced with 2 mM m-TA at OD A600≈0.2, and sampled at 48 hours post-induction for viable cell counts and chondroitin assays. The results of these assays, shown below, suggested that neither gene is absolutely essential for chondroitin biosynthesis in recombinant E. coli K-12.

TABLE 5C

Effects of deletion of kfoB or kfoG on chondroitin production.

| Strain | Plasmid | OD A600 | cfu/mL (×10$^9$) | % Tc$^r$ | chondroitin$^a$ (μg/mL) |
|---|---|---|---|---|---|
| MSC279 | pDD66 | 15.6 | 0.91 | 100 | 564 |
| MSC322 | pCX040 = pDD66ΔkfoB | 12.8 | 0.87 | 100 | 676 |
| MSC323 | pCX041 = pDD66ΔkfoG | 18.4 | 2.81 | 100 | 110 |
| MSC280 | pDD67 | 16.0 | 1.77 | 73 | 384 |
| MSC324 | pCX042 = pDD67ΔkfoB | 15.8 | 1.66 | 70 | 358 |
| MSC325 | pCX043 = pDD67ΔkfoG | 14.9 | 2.24 | 85 | 17 |

$^a$HPLC assay without de-fructosylation step

Based on these results, KfoB protein activity appears to be unnecessary for chondroitin production in these strains under these growth conditions. In fact, in this experiment the strain carrying the deletion of kfoB from pDD66 produced approximately 20% more chondroitin than the strain containing pDD66; see MSC279 vs. MSC322. This difference could be significant but is also within the range of day-to-day variation observed for chondroitin production in recombinant E. coli. In a repeat experiment comparing MSC279 and MSC322, enhanced production of chondroitin by the kfoB deletion strain was not observed. In the pDD67 background, the kfoB deletion appeared to have little or no effect on chondroitin production.

Previous published studies of strain of E. coli K4 that was mutated to inactivate kfoG did not report any effect of the kfoG mutation on the level of fructosylated chondroitin produced (Krahulec et al., 2005). In contrast, our results demonstrate that the KfoG protein, although not absolutely essential for production of chondroitin, appears to be required for the optimal levels of production of recombinant chondroitin in E. coli. under these growth conditions of this experiment. Deletion of the kfoG gene severely reduced production of chondroitin by pDD66 and pDD67. In the pDD66 background, the strain deleted for kfoG (MSC323) produced only approximately 20% as much chondroitin as the wild type control strain MSC279. Similarly, in the pDD67 background, the strain deleted for kfoG (MSC325) produced only approximately 5% as much chondroitin as the wild type control strain MSC280.

Example 8

This Example Demonstrates Recombinant Production of Chondroitin in a Variety of Growth Media, Temperatures, and Induction Conditions A variety of different growth media can support production of chondroitin by recombinant E. coli strains carrying the E. coli K4 chondroitin biosynthesis genes. For optimal production of recombinant chondroitin cultures conditions such as medium composition, temperature, inducer concentration, and duration of culture post-induction need to be optimized.

Initial studies of recombinant production of chondroitin in E. coli used CYG growth medium (20 g/L casamino acids, 5 g/L yeast extract, 2 g/L glucose, pH 7.2). A variety of alternative growth media and culture conditions can be employed to cultivate recombinant E. coli strains capable of producing chondroitin and to achieve chondroitin production.

One alternative culture medium that is well known to support the growth of E. coli is TB medium (Sambrook, J., Fritsch, E. F. and Maniatis, T., Molecular Cloning: A Laboratory Manual, Second Edition, Cold Spring Harbor Laboratory Press, Cold Spring Harbor, N.Y. (1989)). This medium was tested and found to also support production of chondroitin by recombinant E. coli. Further, the effect of prolonged incubation time (up to 72 hours post-induction) on chondroitin production was also tested. Additionally, the effect on chondroitin production of induction with 1 mM vs. 2 mM m-TA was also tested.

Strains MSC279 and MSC280 were grown in shake flasks at 30° C. in TB containing tetracycline at 5 μg/mL. Cultures were inoculated at 0.05 OD A600 and induced by addition of 1 mM or 2 mM m-TA at approximately (0.1-0.2) OD A600. At 24 and 48 hours post-induction, cultures were sampled for chondroitin assays and for viable cell counts. Results of this experiment are summarized in Table 6A below.

TABLE 6A

| strain | m-TA | time$^a$ | OD A600 | cfu/mL (×10$^9$) | % Tc$^r$ | chondroitin$^b$ (μg/mL) |
|---|---|---|---|---|---|---|
| MSC279 | 1 mM | 24 | 10.1 | 2.21 | 81 | 200 |
|  |  | 48 | 14.0 | 1.47 | 58 | 411 |
|  | 2 mM | 24 | 10.2 | 2.13 | 79 | 238 |
|  |  | 48 | 13.5 | 0.93 | 59 | 436 |
| MSC280 | 1 mM | 24 | 10.2 | 2.69 | 76 | 222 |
|  |  | 48 | 15.0 | 2.19 | 84 | 407 |
|  | 2 mM | 24 | 9.9 | 2.08 | 90 | 243 |
|  |  | 48 | 14.5 | 1.27 | 100 | 474 |

$^a$hours, post-induction
$^b$HPLC assay without de-fructosylation treatment

These results demonstrate that TB medium can support significant levels of chondroitin production. Also, extending the culture time significantly increased the chondroitin titer; chondroitin levels approximately doubled from 24 to 48 hours post-induction. Final chondroitin titers of 0.4-0.5 g/L were achieved at 48 hours post-induction. These data also suggest that the higher inducer concentration can result in greater productivity although the magnitude of the effect is not large.

Both CYG and TB are "complex" growth media containing hydrolyzed casein products and autolyzed yeast in which the components of the medium are not chemically defined. In some circumstances it might be desirable to employ a minimal or defined growth medium for cell culture. Some examples of possible defined or minimal media include "2XM9" plus glucose or glycerine and with, or without, supplementation with yeast extract (YE). The basal inorganic salt components of "2XM9" are: 22.6 g/L Na$_2$HPO$_4$.7H$_2$O, 6 g/L KH$_2$PO$_4$, 1 g/L NaCl, 2 mM MgSO$_4$, 0.2 mM CaCl$_2$, and 2.0 g/L NH$_4$Cl (pH 7.4). To this formulation a carbon source is added, and other supplements can be added as indicated. Strains MSC279 and MSC280 were cultured in shake flasks at 30° C. in 2XM9 that contained 10 g/L glucose or glycerine as carbon sources. The effect of supplementation of the glucose containing medium with YE at 1 g/L also was tested. For this experiment the overnight cultures that served as the inocula were grown in LB medium. Cultures were inoculated at 0.05 OD A600 and induced by addition of 1 mM m-TA at approximately 0.1-0.2 OD A600. Cultures containing glucose as the carbon source were sampled at 24 and 48 hours post-induction for viable cell counts and for chondroitin assays. However, the glycerine cultures grew relatively slowly at first and at 24 hours post-induction there was only weak growth, so growth of the glycerine cultures was extended to 72 hours and samples were taken at 48 and 72 hours. Table 6B below summarizes the results of this experiment.

TABLE 6B

| Strain | Growth medium | time | OD A600 | cfu/mL (×10$^9$) | % Tc$^r$ | chondroitin* (μg/mL) |
|---|---|---|---|---|---|---|
| MSC279 | 2xM9 + glucose | 24 | 5.16 | 2.53 | 89 | 110 |
|  |  | 48 | 5.28 | 2.76 | 80 | 181 |
| MSC280 | 2xM9 + glucose | 24 | 5.45 | 3.06 | 74 | 52 |
|  |  | 48 | 5.54 | 3.00 | 74 | 94 |
| MSC279 | 2xM9 + glucose + YE | 24 | 6.13 | 2.36 | 97 | 150 |
|  |  | 48 | 5.37 | 4.46 | 87 | 194 |
| MSC280 | 2xM9 + glucose + YE | 24 | 6.06 | 2.73 | 79 | 99 |
|  |  | 48 | 5.80 | 2.92 | 90 | 120 |
| MSC279 | 2xM9 + glycerine | 48 | 4.62 | 4.62 | 89 | 182 |
|  |  | 72 | 5.84 | 1.94 | 84 | 280 |
| MSC280 | 2xM9 + glycerine | 48 | 5.48 | 2.78 | 88 | 143 |
|  |  | 72 | 6.35 | 2.89 | 81 | 350 |

*HPLC assay without de-fructosylation

Both strains attained final OD A600 of approximately 5-6 in all three media compositions and plasmid retention was relatively good approximately 75-90%. Chondroitin was produced in substantial amounts in all media tested. Titers at harvest ranged from approximately 100 to 350 μg/mL. Addition of yeast extract to 2XM9 plus glucose medium had, at most, a modest effect on final chondroitin titers. Despite an initial growth lag, glycerine cultures grew to final cell densities similar to those seen with glucose. Final titers of chondroitin were higher (1.5- to 3-fold) in the glycerine cultures as compared to the glucose cultures. These results provide examples of minimal/defined media that can support significant levels of chondroitin production. Further media development and optimization can be performed using standard approaches that are well known to one skilled in the art of microbial fermentation process development.

Another experiment demonstrates the effects of growth temperature and extended growth time post-induction times on chondroitin accumulation. Cultures of MSC280 were grown in CYG medium plus 2 μg/mL Tc. Flasks were incubated at 20° C., 25° C., 30° C., and 37° C. Cultures were inoculated at approximately 0.05 OD A600 and grown at the indicated temperatures to approximately 0.1-0.2 OD A600 at which point cultures were induced by addition of 1 mM m-TA where indicated. One control culture at 30° C. was not induced. Samples were collected at 24, 48, and 72 hours post induction for chondroitin assays and viable cell counts. Results from the terminal harvest timepoints are shown below in Table 6C. Under these conditions, chondroitin production was achieved at all temperatures tested but the best chondroitin titers achieved were at 25° C. and 30° C. Chondroitin accumulation increased significantly during the second and third days of growth at all temperatures tested (data not shown). At 37° C., chondroitin production is substantially lower (approximately 10-fold) than at 30° C., and the viability of the 37° C. culture was poor. Further optimization could be achieved by refining the definition of the preferred temperature range for chondroitin production by testing additional temperatures in the range 20° C. to 37° C. Similarly, further optimization could be achieved by refining the effect of time of culture post-induction upon chondroitin titer.

TABLE 6C

| temp. | induction | time$^a$ | OD A600 | cfu/mL (×10$^9$) | % Tc$^r$ | chondroitin (μg/mL) |
|---|---|---|---|---|---|---|
| 20° C. | 1 mM m-TA | 24 | 1.42 | 0.92 | 90 | 12 |
|  |  | 48 | 2.24 | 0.59 | 100 | 36 |
|  |  | 72 | 2.36 | 0.54 | 93 | 55 |
| 25° C. | 1 mM m-TA | 24 | 2.62 | 1.63 | 99 | 45 |
|  |  | 48 | 2.98 | n.a.$^b$ | n.a.$^b$ | 96 |
|  |  | 72 | 3.02 | 0.84 | 82 | 123 |
| 30° C. | 1 mM m-TA | 24 | 2.97 | 0.97 | 76 | 72 |
|  |  | 48 | 3.38 | 1.35 | 82 | 107 |
|  |  | 72 | 3.36 | 0.57 | 74 | 119 |
| 30° C. | not induced | 24 | 2.83 | 0.66 | 73 | 25 |
|  |  | 48 | 3.73 | 0.44 | 68 | 42 |
|  |  | 72 | 2.82 | 0.45 | 80 | 62 |
| 37° C. | 1 mM m-TA | 24 | 2.44 | n.a.$^b$ | n.a.$^b$ | 10 |
|  |  | 48 | 2.22 | 0.07 | n.d.$^c$ | 13 |

$^a$hours post-induction
$^b$data not available
$^c$not determined, no colonies obtained on Tet plates Additional studies to optimize time of incubation by extending the incubation time even further may further increase chondroitin production. Similarly, additional concentrations of inducer may be tested to identify the optimal concentration for chondroitin production.

Example 9

This Example Demonstrates that Recombinant Chondroitin can be Secreted to the Culture Medium in E. coli K-12 and E. coli B. This Example Further Demonstrates that Chondroitin Can Also be Produced Intracellularly at High Levels When E. coli K4 is cultured in liquid media, the capsular polysaccharide (K4P), fructosylated chondroitin, is reported to accumulate in a cell-free form in the culture medium and as a cell associated form (Manzoni et al., Biotech. Lett. 1996; 18:383-386, Cimini at al. Appl. Microbiol. Biotechnol. E-Publication, E-Pub. October 2009). By analogy to other group 2 capsular polysaccharides, such as those produced by E. coli serotype K1 and E. coli serotype K5, the cell associated form is believed primarily to be associated with the outer leaflet of the outer membrane of the cell by means of a lipid anchor (Whitfield, 2006). The nature of the linkage between the polysaccharide and the lipid anchor has not been defined at a structural level, nor has the identity of the lipid anchor been determined Recombinant chondroitin produced and detected as described in Examples 6-8 above is clearly present in the culture medium. Low speed centrifugation (10 minutes at 3500 g) is sufficient to remove cells from the culture medium of samples to be assayed for chondroitin, and significant quantities of chondroitin have been detected in the cell-free supernatants. However, all samples that were assayed for chondroitin in Examples 6-8 above were autoclaved prior to centrifugation in order to kill the bacteria and thus facilitate sample handling. The autoclaving step could potentially disrupt the linkage of any cell-associated chondroitin and result in such cell-associated chondroitin being released from the cell. In order to determine whether recombinant chondroitin is produced in cell-free and/or cell-associated forms, an experiment was performed that tested the effect of autoclaving on partitioning of recombinant chondroitin into supernatant and pellet fractions following centrifugation of samples from chondroitin-producing cultures.

Strain MSC279 was grown in a shake flask in TB medium 5 μg/mL Tc at 30° C. The culture was inoculated at approximately 0.03 OD A600 and grown to approximately 0.1-0.2 A600 at which point it was induced by addition of 2 mM m-TA. At 48 hours post-induction samples were taken and assayed for chondroitin. One aliquot of this culture was autoclaved prior to being centrifuged, and the resulting supernatant and cell pellet fractions were assayed for chondroitin according to the HPLC method of Example 14. Another aliquot was centrifuged without being autoclaved and the resulting supernatant and cell pellet fractions were assayed for chondroitin according to the HPLC method of Example 14. A cell pellet from a non-autoclaved sample was resuspended in THB (50 mM Tris-HCl buffer with 50 mM sodium acetate pH 8.0) and treated directly with chondroitinase ABC ("CHase") (without cell lysis) and again centrifuged to generate supernatant and pellet fractions for assay. To test for cell-free chondroitin carried over in residual culture medium, another cell pellet from a non-autoclaved sample was gently washed in THB then re-centrifuged. The supernatant from the wash (sample #7) and the cell pellet (without lysis) from the wash (sample #8) were assayed for chondroitin as above. Results of this experiment are shown in Table 7A below.

TABLE 7A

| Sample | | sample #/ fraction | chondroitin (µg/mL) |
|---|---|---|---|
| autoclaved culture medium | | 1 supernatant | 403 |
| | | 2 pellet (lysis assay) | 50 |
| non-autoclaved culture medium | | 3 supernatant | 217 |
| | | 4 pellet (lysis assay) | 178 |
| Pellet from non-autoclaved culture medium | resuspended + CHase, CFGed | 5 supernatant | 130 |
| | | 6 pellet (lysis assay) | 66 |
| | washed 1X, resuspended + CHase, CFGed | 7 wash superantant | 8 |
| | | 8 wash pellet | 154 |

In the autoclaved sample, only 11% of the total chondroitin was present in the cell-pellet (sample #2) whereas 45% of the total chondroitin was present in the cell pellet in the sample (sample #4) that was not autoclaved prior to centrifugation. This result indicates that a significant fraction of the chondroitin produced by MSC279 remains cell-associated and that the autoclaving step disrupts the association of the chondroitin with the cell. The cell-associated chondroitin in the pellet of the non-autoclaved strain was found to be digested by direct CHase treatment of resuspended cells without lysis treatment. The quantity of surface-associated chondroitin calculated based on the amount of disaccharide released was determined to be 130-154 µg/mL (sample #5 and sample #8) in the original culture. This value is somewhat less than the cell-associated chondroitin titer (178 µg/mL) measured by the "cell lysis" technique of Example 14 (sample #4), which may reflect internal chondroitin polymer (as measured in sample #2 and sample #6). However, the data from both assay methods are qualitatively in agreement as indicating that a significantly higher fraction of chondroitin is cell-associated in the non-autoclaved sample as compared to the autoclaved sample. The fact that the cell-associated chondroitin was digested to disaccharide by CHase treatment of the whole-cell suspension indicates that this fraction of the chondroitin is associated with the outer membrane of the cell in such a way that the polysaccharide resides outside of the cell and in the culture medium. This is consistent with the expected structure of the capsule.

These results demonstrate that a significant fraction (≥50%) of the recombinant chondroitin produced by strain MSC279 is present in the culture medium and in a form that is not cell associated. The bulk of the cell-associated chondroitin produced by MSC279 is attached to the cell but is accessible to the surrounding medium as evidenced by degradation by added CHase. The production of both cell-free and cell-associated forms of K4P by native *E. coli* K4 has been previously reported by Manzoni et al., *Biotechnol. Lett.* 1996; 18(4):383-386 and Cimini et al., *Appl. Microbiol. Biotechnol.* E-Publication, October 2009. The observation of both forms during recombinant production is consistent with the notion that the synthesis and secretion of recombinant chondroitin in MSC279 proceeds by the same pathways that operate in the native strain. This suggests that all of the cloned genes introduced into MSC279 are functioning in the same manner as in *E. coli* K4 and that the complete pathway for synthesis and export of the capsule polysaccharide is functioning in the recombinant strain.

In order to produce chondroitin by bacterial fermentation it is preferable to use large scale fermentations, which generate volumes of culture media that are too large for autoclaving to be feasible as a method for releasing cell-associated chondroitin into the culture medium. Alternative treatments using elevated temperature in combination with acid or base treatment could be employed for large scale manufacturing.

Similar results for secretion of chondroitin into culture medium were also obtained with recombinant *E. coli* B strains that produce chondroitin. We observed previously that in recombinant *E. coli* K-12 the kfoB gene was not essential for chondroitin production. To test for secretion of chondroitin in *E. coli* B, MSC347 (MSC139 pCX044 i.e. pCX039ΔkfoB) was grown in TB/Tc$^5$ medium at 30° C. and induced at OD A600 approximately 0.15 with 2 mM m-TA. At 48 hours, broth samples were taken and centrifuged with, and without, autoclaving to generate supernate and cell pellet fractions. Chondroitin assay results of this experiment are shown below in Table 7B. Autoclaving resulted in greater than 90% of the total measurable rCH in the supernatant fraction. In non-autoclaved samples, however, only approximately 30% of the chondroitin was found in the supernatant. These results are consistent with findings with recombinant *E. coli* K-12 strains, as detailed above, which suggest that the autoclave step (5 minutes, 121° C., 15 psi) releases essentially all rCH into the medium. These results further show that the regions 1 and 3 genes in *E. coli* B function to secrete chondroitin when the region 2 genes are present.

TABLE 7B

| strain | description | OD A600 | treatment | sample | chondroitin µg/mL |
|---|---|---|---|---|---|
| MSC347 | MSC139 pCX044 pCX044 = pCX039 (ΔkfoB) | 12.6 | autoclaved | supernate | 362 |
| | | | | cell pellet | 25 |
| | | | non-autoclaved | supernate | 107 |
| | | | | cell pellet | 242 |

Secretion of chondroitin into cell culture medium and release of cell-associated chondroitin into the culture medium provide a method for obtaining chondroitin that is cell free and can be separated from cells by centrifugation or filtration and subsequently purified. It is also possible to produce intracellular chondroitin by genetic manipulation of the chondroitin biosynthesis genes. Intracellular production of chondroitin could be desirable in order to eliminate viscosity of the fermentation resulting from high levels of polysaccharide in the culture medium. In addition, the intrinsic limits upon chondroitin production and the biochemistry of chondroitin biosynthesis in *E. coli* are incompletely understood. It is possible that intracellular production could achieve higher levels of chondroitin than secretion. Therefore, recombinant gene sets that allow accumulation of significant levels of chondroitin in the absence of secretion into the culture medium were identified.

There is evidence in the literature that under certain conditions, other *E. coli* capsular polysaccharide can be synthesized and accumulate intracellularly. Electron microscopy (EM) results of Bronner et al. (*J. Bact.* 1993; 175:5984-5992) suggested that there was some intracellular accumulation of the *E. coli* serotype K5 capsular polysaccharide (heparosan) by mutants defective in kpsC and kpsS. Similar observations were reported by Cieslewicz and Vimr, (*J. Bact.* 1996; 178: 3212-3220) for the polysialic acid capsular polysaccharide of *E. coli* K1 when mutants defective in kpsC, kpsS, kpsE or kpsT were examined by EM. The levels of intracellular K1 and K5 polysaccharides were not quantitated in these studies.

To determine if mutations in region 1 or region 3 genes could block secretion of recombinantly produced chondroitin in *E. coli* K-12, derivatives of plasmid pDD66 that are deleted for kpsC or kpsT genes (pCX045 and pCX048 respectively) were constructed as described in Example 4. These plasmids were transformed into MSC188 and the resulting strains were tested in parallel with MSC279 (MSC188 containing unmodified pDD66) for the ability to produce and secrete chondroitin to the culture medium.

Cultures were grown in TB+Tc5 medium at 30° C., induced with 2 mM m-TA at OD A600 of approximately 0.15, and sampled after 48 hours. For each strain at the 48 hour time point, chondroitin was assayed in the supernates and cell pellets from both autoclaved and non-autoclaved samples. As shown in Table 7C below, the ODs at 48 hours were equivalent. In non-autoclaved samples from strains MSC356 and MSC359, which are deleted for kpsC and kpsT genes respectively, chondroitin is predominantly (approximately 85-90%) localized to the cell pellet. This is in contrast to the results with MSC279, the wild-type control, in which approximately 50% of the chondroitin is localized to the cell pellet and approximately 50% is present in the supernatant.

TABLE 7C

| strain | plasmid | OD A600 | sample | chondroitin (µg/mL) |
|---|---|---|---|---|
| MSC279 | pDD66 | 13.5 | non-autoclaved supernatant | 265 |
|  |  |  | non-autoclaved pellet | 260 |
|  |  |  | autoclaved supernatant | 499 |
|  |  |  | autoclaved pellet | 54 |
| MSC356 | pCX045 = DD66ΔkpsC | 13.5 | non-autoclaved supernatant | 59 |
|  |  |  | non-autoclaved pellet | 329 |
|  |  |  | autoclaved supernatant | 400 |
|  |  |  | autoclaved pellet | 31 |
| MSC359 | pCX048 = pDD66ΔkpsT | 13.4 | non-autoclaved supernatant | 50 |
|  |  |  | non-autoclaved pellet | 388 |
|  |  |  | autoclaved supernatant | 421 |
|  |  |  | autoclaved pellet | 105 |

As described above (Table 7C) in strain MSC279, most of the chondroitin localized to the cell pellet in non-autoclaved samples of MSC279 cultures is likely covalently attached to a lipid anchor in the outer leaflet of the cell outer membranes. It is likely that autoclaving disrupts the association of the cell membrane and chondroitin that is cell-associated in the absence of autoclaving, but the effects of autoclave treatment of the cells are not fully understood. The nature of the association between the cell and the chondroitin that is localized to the cell pellets of the kpsC or kpsT defective strains is not addressed by these data. In principle, this chondroitin could be present in the cell cytoplasm, in the periplasmic space, or still attached to the outer cell membrane. However, the results for these mutant strains are consistent with the notion that mutations in kpsC and kpsT block secretion of chondroitin and result in intracellular accumulation of chondroitin. Presence of this chondroitin on the cell surface can be tested by resuspending the non-autoclaved cell pellet, subjecting the resuspended cells to CHase digestion and measuring the production of the chondroitin specific disaccharide. Alternatively, electron microscopy can be employed to determine the cellular location of cell-associated chondroitin produced by MSC356 and MSC359.

An additional experiment, detailed below, was designed to confirm the role of autoclaving in the release of chondroitin from the cell with wild type strain MSC279, and to determine whether *E. coli* K-12 containing only the K4 region 2 genes (MSC346; MSC188 pCX039) could produce intracellular chondroitin. Strains MSC279 and MSC346 were grown in TB/Tc5 medium at 30° C. and induced at OD A600 approximately 0.15 with 2 mM m-TA. After 48 hours, duplicate broth samples were taken to generate supernate and cell pellet fractions, with, and without, autoclaving prior to centrifugation. Chondroitin assay results from these samples are shown in Table 7D below. In the non-autoclaved samples from strain MSC279, which contains the complete chondroitin biosynthetic gene set, chondroitin was approximately evenly distributed between supernate (55%) and pellet (45%). In contrast, the non-autoclaved pellet from strain MSC346, which contains only region 2 genes, included approximately 98% of the chondroitin produced by that culture—little was found in the supernate. For both strains, autoclaving resulted in partitioning of the CH predominantly (>90%) into the supernates.

TABLE 7D

| strain | description | treatment | fraction | CH (µg/mL) |
|---|---|---|---|---|
| MSC279 | MSC188 pDD66 | autoclaved | supernate | 485 |
|  |  |  | cell pellet | 38 |
|  |  | non-autoclaved | supernate | 230 |
|  |  |  | cell pellet | 186 |
| MSC346 | MSC188 pCX039 | autoclaved | supernate | 200 |
|  |  |  | cell pellet | 13 |
|  |  | non-autoclaved | supernate | 3 |
|  |  |  | cell pellet | 151 |

These results demonstrate that autoclaving (5 min., 121° C., 15 psi) releases almost all cell-associated chondroitin into the medium. Consequently, the chondroitin detected in the non-autoclaved cell pellet of MSC279 could, in principal, be bound to the outer membrane or have an intracellular location. In the absence of autoclaving, very little chondroitin is found in the supernatant of the strain MSC346 culture. This result is consistent with MSC346, which lacks all region 1 and region 3 functions, producing only intracellular chondroitin. Although lower amounts of chondroitin are produced by MSC346, as compared to MSC279, the quantity of chondroitin produced is still significant and demonstrates that chondroitin can be successfully produced using only cloned genes kfoABCFG in recombinant *E. coli* K-12. These results also demonstrate that this chondroitin can be liberated from the cell by autoclaving and obtained in the supernatant of autoclaved cultures following centrifugation to remove cellular debris. Alternatively, cells of MSC346 could be lysed by a variety of methods that are well known (e.g. homogenization, detergent and/or enzymatic lysis, mechanical disruption, sonication and the like) and the chondroitin released by these methods could be also be recovered in the supernatant

Example 10

This Example Describes the Construction of Strains of *E. coli* K-12 that Contain the Chondroitin Biosynthesis Genes Inserted in the Chromosome and Demonstrates Chondroitin Production in these Strains Examples 6-9 above describe chondroitin production in recombinant *E. coli* strains using plasmid vectors to introduce cloned genes that encode the chondroitin biosynthesis proteins into heterologous host strains. In some circumstances it could be desirable to introduce the cloned chondroitin biosynthesis genes into the chromosome of the recipient host strain. Placing the cloned genes in the chromosome eliminates the requirement for maintaining selective pressure to maintain the plasmid(s) which carry the chondroitin biosynthesis genes and could thus potentially provide more stable expression strains or expression strains that are stable in the absence of selective pressure. Therefore, *E. coli* K-12 strains were constructed in which the *E. coli* K4 genes for chondroitin biosynthesis are stably integrated into the host chromosome. These "chromosomal expression strains" employ the Pm promoter and K4 gene sets from pDD66 and pBR1052 integrated at the colanic acid biosynthesis locus. The xylS regulatory gene also has been integrated into the chromosome at a separate locus, the fhuA locus. Resulting constructs were shown to produce high levels of chondroitin in shake flasks and in fermentors (Examples 14 and 15).

Expression plasmids pDD66 and pBR1052 are described in Example 4. The K4 chondroitin biosynthesis genes from pDD66 and pBR1052 were cloned into the pMAK-CL replacement vector which is also described in Example 3. This vector, diagramed in FIG. 8L, contains cloned DNA regions upstream and downstream of the colanic acid (CA) gene cluster and a unique AscI cloning site at the junction of these regions. As detailed in Example 3, this vector was used to construct a deletion of the entire CA gene cluster in *E. coli* K-12 W3110 to generate strain MSC188. The K4 gene expression cassettes were excised and gel-purified using the QIAEX II Gel Extraction Kit (QIAGEN Inc., Valencia, Calif.) according to the vendor protocol from pDD66 and pBR1052 as approximately 19 kb AscI fragments and these fragments were ligated with pMAK-CL DNA that was AscI-digested, phosphatase-treated, and gel-purified. Transformants were selected for resistance to tetracycline which is carried on the AscI fragments of pDD66 and pBR1052 along with the Pm promoters and the upstream and downstream transcription terminators. Derivatives of pMAK-CL that contained the AscI fragments of pBR1052 or pDD66 were identified and designated pDD74 and pDD76, respectively. These plasmids are diagramed in FIG. 8L.

Plasmids pDD74 and pDD76 were transformed into MSC188 to generate strains MSC373 and MSC377, respectively, and derivatives of these strains in which the K4 gene set is integrated into the chromosome were obtained as follows. MSC373 and MSC377 were grown overnight at 30° C. in LB+5 µg/mL tetracycline ($Tc^5$) and an aliquot of approximately 20 µL was spotted and streaked onto an LB+$Tc^5$ plate which was incubated overnight at 41° C. Colonies that arose on this plate were picked and re-streaked on LB+$Tc^5$ plates at 43° C. Selection for maintenance of the plasmid-borne antibiotic resistance at high temperature selects for recombination of the plasmid into the chromosome because the pDD74 and pDD76 plasmids, as derivatives of the pMAK705 vector, are temperature-sensitive for replication (Hamilton et al., *J Bact.* 1989; 171:4617-4622). Derivatives of MSC373 and MSC377 that were capable of growth at 43° C. on tetracycline were sub-cultured overnight once in LB+$Tc^5$ liquid medium at 30° C. and subsequently once overnight in LB liquid medium (without tetracycline) at 30° C. These overnight cultures were then diluted and plated on LB plates at 30° C. and isolated colonies were toothpicked onto LB, LB+$Tc^5$, and LB+34 µg/mL chloramphenicol ($Cm^{34}$) at 30° C. One tetracycline-resistant (TcR), chloramphenicol-sensitive (CmS) derivative was identified from each of MSC377 and MSC373. These TcR, CmS derivatives, termed MSC391 and MSC392, respectively, were putative replacement strains in which recombination has occurred in such a way the K4 DNA sequence remains in the chromosome at the CA locus while the remainder of the plasmid sequences have been excised by homologous recombination and the plasmid subsequently lost. PCR analyses of these isolates showed that the 5' and 3' ends of the approximately 19 kb K4 DNA fragment are present in the expected location with respect to the chromosomal DNA sequences that flank the colanic acid locus.

As detailed in Example 4, DNA regions upstream and downstream of the *E. coli* fhuA gene were cloned by PCR, assembled and sequenced and this deletion fragment moved into the pMAK705 suicide plasmid to create a replacement vector for the fhuA locus termed pMAK705-ΔfhuA, or pDD73 (FIG. 8M). The xylS regulatory gene was cloned into this replacement vector as follows. The xylS gene was excised from pDD42 as a PstI fragment and cloned into the PstI site of pDD73 to generate pDD77, which is diagramed in FIG. 8N. The PstI fragment of pDD77 is identical to the xylS-containing PstI fragment present in expression plasmids pDD66 and pBR1052, and the parent vector pDD54. The K4 gene cluster replacement strains, MSC391 and MSC392, described above were transformed with pDD77. Two isolates each from transformation of MSC391 and MSC392 by pDD77 were selected and designated as follows:

MSC402≡MSC391 pDD77 "isolate A"
MSC403≡MSC391 pDD77 "isolate B"
MSC404≡MSC392 pDD77 "isolate A"
MSC405≡MSC392 pDD77 "isolate B"

These strains were all tested in shake flasks for chondroitin biosynthesis. Strains were grown in TB medium at 30° C.+$Cm^{34}$ to select for maintenance the pDD77 plasmid. At OD A600 of approximately 0.2, cultures were induced by addition of 2 mM m-toluic acid (m-TA). Samples were taken at 24 and 48 hours post-induction and assayed for chondroitin. All four strains produced chondroitin. Results of these assays are shown in Table 8A below. The chondroitin levels for induced MSC404 and MSC405 were approximately 2.5-fold higher than MSC402 and MSC403. In this experiment, MSC404 and MSC405 produced about 65-70% the amount typically seen with MSC279 (MSC188 pDD66) in shake flasks under these culture conditions; approximately 0.5 g/L. These results indicate that recombinant *E. coli* containing a single chromosomal copy of the K4 chondroitin biosynthesis genes is capable of producing significant amounts of chondroitin.

TABLE 8A

| Sample | Strain description | CH µg/mL | OD A600 |
|---|---|---|---|
| #1 MSC402 uninduced 24 h | MSC391 pDD77 isolate A | 11 | 11.6 |
| #2 MSC402 + mTA 24 h | MSC391 pDD77 isolate A | 47 | 10.2 |

TABLE 8A-continued

| Sample | Strain description | CH µg/mL | OD A600 |
|---|---|---|---|
| #3 MSC403 uninduced 24 h | MSC391 pDD77 isolate B | 7 | 11.2 |
| #4 MSC403 + mTA 24 h | MSC391 pDD77 isolate B | 47 | 10.0 |
| #5 MSC404 uninduced 24 h | MSC392 pDD77 isolate A | 64 | 11.4 |
| #6 MSC404 + mTA 24 h | MSC392 pDD77 isolate A | 114 | 9.4 |
| #7 MSC405 uninduced 24 h | MSC392 pDD77 isolate B | 16 | 11.7 |
| #8 MSC405 + mTA 24 h | MSC392 pDD77 isolate B | 137 | 9.7 |
| #9 MSC402 uninduced 48 h | MSC391 pDD77 isolate A | 29 | 15.9 |
| #10 MSC402 + mTA 48 h | MSC391 pDD77 isolate A | 152 | 15.7 |
| #11 MSC403 uninduced 48 h | MSC391 pDD77 isolate B | 23 | 15.6 |
| #12 MSC403 + mTA 48 h | MSC391 pDD77 isolate B | 111 | 15.6 |
| #13 MSC404 uninduced 48 h | MSC392 pDD77 isolate A | 142 | 15.7 |
| #14 MSC404 + mTA 48 h | MSC392 pDD77 isolate A | 344 | 14.9 |
| #15 MSC405 uninduced 48 h | MSC392 pDD77 isolate B | 33 | 15.3 |
| #16 MSC405 + mTA 48 h | MSC392 pDD77 isolate B | 329 | 15.4 |

The strains (MSC404 and MSC405) derived from pBR1052 appeared to be more productive than the strains derived from pDD66, but both chromosomal genes sets functioned sufficiently well to produce chondroitin. The chromosomal K4 gene set derived from pBR1052 contains a second copy of the Pm promoter inserted immediately upstream of the kpsF gene. This added promoter was shown to enhance expression of the downstream genes (kpsFEDUCS) in the plasmid pBR1052 relative to expression in pDD66. It is possible that the additional Pm promoter also increases downstream gene expression in the chromosomal context and that the enhanced expression of these genes can significantly increase CH production.

Derivatives of MSC403 and MSC405 were obtained in which the plasmid-borne xylS gene of pDD77 was integrated into the chromosome at the fhuA locus using the two step "pop-in/pop-out" method as follows. MSC403 and MSC405 were grown overnight at 30° C. in LB+Cm$^{34}$. These cultures were diluted 10$^4$-fold and 0.1 mL aliquots were plated on LB+Cm$^{34}$ at 43° C. After overnight incubation approximately 100 colonies of varying size were obtained. Isolated colonies were picked and streaked onto LB+Cm$^{34}$ plates and grown overnight at 43° C. Isolated colonies from these platings were picked and used to inoculate 5 mL cultures of LB without any antibiotic. These cultures were grown overnight at 30° C. and subsequently twice passaged by 1000-fold dilution and overnight growth in LB at 30° C. This third passage was then diluted 10$^6$-fold and 0.1 mL aliquots were plated on LB at 30° C. and 37° C. Individual colonies from these platings were toothpicked onto LB and LB+Cm$^{34}$ to test for loss of the plasmid. Chloramphenicol-sensitive (CmS) isolates were readily obtained, and these were screened by PCR to identify the desired "pop-out" replacement strains in which recombination occurred in such a way that the xylS-containing DNA sequence remained in the chromosome at the fhuA locus while the remainder of the plasmid sequences were excised and the plasmid subsequently lost. This event also results in deletion of the entire fhuA gene from the E. coli chromosome. PCR analyses of these isolates indicated that the 5' and 3' ends of the xylS DNA fragment now are present in the expected location with respect to the chromosomal DNA sequences that flank the fhuA locus. The resulting strains, MSC410, derived from MSC403, and MSC411, derived from MSC405, contain the xylS gene inserted at the fhuA locus and retain the K4 genes inserted at the colanic acid locus.

MSC410 and MSC411 were tested for chondroitin biosynthesis. Strains were grown in TB medium at 30° C. and at OD A600 of approximately 0.2, cultures were induced by addition of 2 mM m-TA. Samples were taken at 24 and 48 hours post-induction and assayed for chondroitin. As shown below in Table 8B, all of these strains produced very low levels of chondroitin.

TABLE 8B

| Sample | CH µg/mL | OD A600 |
|---|---|---|
| MSC410 uninduced 24 h | 1.5 | 10.8 |
| MSC410 + mTA 24 h | 2.4 | 9.3 |
| MSC411 uninduced 24 h | 2.0 | 11.6 |
| MSC411 + mTA 24 h | 5.9 | 10.7 |
| MSC410 uninduced 48 h | 3.7 | 16.5 |
| MSC410 + mTA 48 h | 5.2 | 14.7 |
| MSC411 uninduced 48 h | 4.4 | 15.4 |
| MSC411 + mTA 48 h | 12.2 | 16.1 |

This low productivity was unexpected, given that the immediate predecessor strains produced significant quantities of chondroitin at comparable cell densities under the same culture conditions. A priori, these results could indicate that the chromosomal insertion of the xylS gene does not produce a sufficient quantity of XylS protein to activate the Pm promoter even in the presence of the inducer m-TA. Alternatively, the presumed DNA structures of the inserted K4 and/or xylS genes in these strains might not be correct. The linkage relationships of the 5' and 3' ends of both segments with respect to the chromosomal sequences flanking the homologous colanic acid locus and fhuA locus sequences were verified by PCR. However, those data alone do not confirm the precise structures and sequences of the inserted DNAs in these strains. Rearrangement, deletion or mutation within the K4 or xylS DNA segments could have occurred in the course the derivation of MSC410 and MSC411 from their respective CH-producing parents (MSC403 and MSC405) and could have resulted in impairment of CH biosynthesis.

Experiments were performed to test these hypotheses. Plasmid pDD77 was transformed into MSC410 and MSC411 to test for the functionality of the chromosomal K4 gene sets in these two strains. The resulting strains were designated MSC436 (MSC410 pDD77 "isolate A"), MSC437 (MSC410 pDD77 "isolate B"), MSC438 (MSC411 pDD77 "isolate A") and MSC439 (MSC411 pDD77 "isolate B"). These strains were grown in TB medium at 30° C. and at OD A600 of approximately 0.2, cultures were induced by addition of 2 mM m-TA. Samples were taken at 24 and 48 hours post-induction and assayed for chondroitin. As shown below in Table 8C, these four strains produced significant titers of chondroitin very similar to titers seen for their antecedent strains MSC403 and MSC405 and much higher than their immediate predecessor strains MSC410 and MSC411. These results indicated that the defect in chondroitin biosynthesis in strains MSC410 and MSC411 does not result from a defect in the K4 chondroitin biosynthesis genes per se.

TABLE 8C

| Strain description | Sample | CH µg/mL | OD A600 |
|---|---|---|---|
| MSC403 = MSC391 + pDD77 (isolate B) | #11 uninduced 48 h | 23 | 15.6 |
| | #12 + mTA 48 h | 111 | 15.6 |
| MSC410 = MSC403 derivative having xylS in the chromosome | #29 uninduced 48 h | 4 | 16.5 |
| | #30 + mTA 48 h | 5 | 14.7 |
| MSC436 = MSC410 + pDD77 (isolate A) | #53 uninduced 48 h | 16 | 16.3 |
| | #54 + mTA 48 h | 124 | 15.3 |
| MSC437 = MSC410 + pDD77 (isolate B) | #55 uninduced 48 h | 14 | 16.0 |
| | #56 + mTA 48 h | 143 | 15.4 |
| MSC405 = MSC392 + pDD77 (isolate B) | #15 uninduced 48 h | 33 | 15.3 |
| | #16 + mTA 48 h | 329 | 15.4 |

TABLE 8C-continued

| Strain description | Sample | CH µg/mL | OD A600 |
|---|---|---|---|
| MSC411 = MSC405 derivative having xylS in the chromosome | #31 uninduced 48 h | 4 | 15.4 |
| | #32 + mTA 48 h | 12 | 16.1 |
| MSC438 = MSC411 + pDD77 (isolate A) | #57 uninduced 48 h | 30 | 16.2 |
| | #58 + mTA 48 h | 331 | 15.0 |
| MSC439 = MSC411 + pDD77 (isolate B) | #59 uninduced 48 h | 26 | 16.4 |
| | #60 + mTA 48 h | 209 | 14.0 |

These findings suggest that chondroitin biosynthesis in strains MSC410 and MSC411 could be low due to a defect in XylS protein function resulting from some structural error in the gene coding sequence that could possibly have occurred during the generation of MSC410 and MSC411 (from MSC403 and MSC405, respectively) or, alternatively, the xylS gene sequence might be correct, but the expression level of the chromosomal xylS gene in these constructs might be insufficient to achieve optimal expression of the K4 genes.

The xylS genes the in chromosomes of MSC410 and MSC411 were sequenced to test these hypotheses. The region of the E. coli chromosome containing the xylS gene insertion was amplified by PCR using primers that flank the integration site and the amplified DNA segment was sequenced. The sequence of the xylS promoter and coding regions exactly matches the expected sequence. This result suggested that the defect in xylS function in MSC410 and MSC411 is due to insufficient expression of the XylS protein from the chromosomal gene. Therefore, experiments were performed to enhance expression of the xylS gene. Toward that end, a synthetic optimized version of the xylS gene promoter, ribosome binding site, and 5' untranslated region (UTR) was designed and synthesized, and those modified sequences were introduced into the xylS replacement vector pDD77 and subsequently into the chromosome.

The synthesized fragment contains 134 bp of sequence matching the BlpI-PstI sequence of pDD77 followed by 86 bp of synthetic sequence up to the ATG start codon of xylS and extends 37 bp further into xylS coding sequence through the unique BglII site. The sequence from the ATG through the BglII site matches the sequence present in pDD77. The BlpI-BglII fragment can be readily introduced into pDD77 because these restriction sites are unique in this plasmid. The 86 bp synthetic sequence (shown below) (SEQ ID NO:98) includes a consensus E. coli promoter (based on Hawley and McClure, Gene 1983; 11:2237-2255.) and a consensus Shine-Dalgarno (S-D) sequence (Shine and Dalgarno Proc. Natl. Acad. Sci. USA. 1974; 71:1342-6). The sequence also incorporates a stem-loop structure (indicated by underlined text) at the 5' end of the predicted mRNA. All of these features are expected to promote efficient expression of the XylS protein.

place of the native BlpI-BglII fragment containing the native xylS regulatory sequences. The plasmid containing the modified xylS, termed pDD79 (FIG. 8N), was transformed into MSC392 to test the ability of the modified xylS gene to activate the Pm promoter and drive chondroitin production. Three MSC392 transformants containing pDD79 were picked and designated MSC458, MSC459 and MSC460. These strains, along with the MSC392 parent, were tested for chondroitin production in the standard shake flask experiment. Strains were grown in TB medium (MSC392), or TB+Cm$^{34}$ (MSC458-460), at 30° C. and, at OD A600 of approximately 0.2, cultures were induced by addition of 2 mM m-TA. Samples were taken at 24, 48 and 72 hours post-induction. The 48 hour samples were assayed for chondroitin. All of the pDD79-containing strains produced approximately 300 µg/mL in both induced, and uninduced, cultures. In contrast, MSC392, lacking a xylS gene, produced only 4 µg/mL chondroitin in both induced, and uninduced, cultures. These results are shown below in table 8D.

TABLE 8D

| Strain description | Sample | CH µg/mL | OD A600 |
|---|---|---|---|
| MSC392 = K4 gene set in chromosome | #69; uninduced 48 h | 4 | 15.9 |
| | #70; + m-TA 48 h | 4 | 16.0 |
| MSC458 = MSC392 + pDD79 (modified xylS) | #71; uninduced 48 h | 314 | 14.8 |
| | #72; + m-TA 48 h | 277 | 15.0 |
| MSC459 = MSC392 + pDD79 (modified xylS) | #73; uninduced 48 h | 325 | 13.9 |
| | #74; + m-TA 48 h | 299 | 15.1 |
| MSC460 = MSC392 + pDD79 (modified xylS) | #75; uninduced 48 h | 355 | 13.9 |
| | #76; + m-TA 48 h | 279 | 15.4 |

The observed value of approximately 300 µg/mL chondroitin is similar to titers seen for induced cultures of MSC405 and MSC438, which contain the native xylS gene on plasmid pDD77. However, both uninduced and induced cultures of MSC458, MSC459 and MSC460 produced essentially equivalent CH titers. This result is consistent with increased production of XylS by the modified xylS gene of pDD79 because overproduction of XylS has been reported to activate the Pm promoter in the absence of any added inducer (Dominguez-Cuevas et al., J. Bact. 2008; 190:3118-3128.).

To test the functionality of the modified xylS gene when inserted into the chromosome, derivatives of MSC459 were obtained in which the plasmid-borne xylS gene of pDD79 was integrated into the chromosome at the fhuA locus using the two step "pop-in/pop-out" method as detailed above in Example 3. MSC459 was grown overnight at 30° C. in LB+34 µg/mL chloramphenicol (Cm$^{34}$) and plated on LB+Cm$^{34}$ at 43° C. After overnight incubation, isolated colonies were picked and streaked onto LB+Cm$^{34}$ plates and again grown overnight at 43° C. Isolated colonies from these platings were

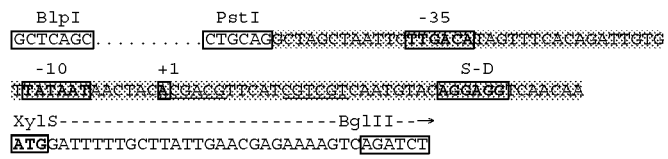

The BlpI-BglII fragment (SEQ ID NO:140) was synthesized by a commercial vendor (DNA2.0) and the synthetic DNA containing the modified sequences was cloned into the xylS replacement vector, pDD77, as a BlpI-BglII fragment in picked and tested by colony PCR to confirm integration of the plasmid into the chromosome.

Two colonies that tested positive by PCR were used to inoculate 5 mL cultures of LB without any antibiotic. These cultures were grown overnight at 30° C. and subsequently passaged by 1000-fold dilution and overnight growth in LB at 30° C. These cultures were then diluted $10^6$-fold and 0.1 mL aliquots were plated on LB at 37° C. Individual colonies from these platings were toothpicked onto LB and LB+$Cm^{34}$ to test for loss of the plasmid. Chloramphenicol-sensitive (CmS) isolates were readily obtained and 6 such isolates from each culture were screened by PCR to identify the desired "pop-out" replacement strains in which recombination occurred in such a way that the xylS-containing DNA sequence remained in the chromosome at the fhuA locus while the remainder of the plasmid sequences were excised and the plasmid subsequently lost. This event also results in deletion of the entire fhuA gene from the *E. coli* chromosome. PCR analyses of these isolates indicated that the 5' and 3' ends of the xylS DNA fragment now are present in the expected location with respect to the chromosomal DNA sequences that flank the fhuA locus. Two such strains, MSC466 and MSC467, derived from MSC459, should now carry the xylS gene (with synthetic promoter) inserted at the fhuA locus and the K4 genes inserted at the colanic acid locus.

MSC466 and MSC467 were tested for chondroitin biosynthesis in shake flasks. Strains were grown in TB medium at 30° C. and, at OD A600 of approximately 0.2, cultures were induced by addition of 0, 1, 2 or 4 mM m-TA. Samples were taken at 24, 48 and 72 hours post-induction. Chondroitin assay data from the 48 hour samples are shown below in Table 8E. Both strains produced substantial titers of chondroitin (>400 μg/mL) when induced with 1 or 2 mM m-TA. Cultures induced with 4 mM m-TA produced somewhat lower chondroitin titers. Uninduced cultures produced lesser amounts of chondroitin, approximately 160-170 μg/mL. These results are consistent with the hypothesis that the modified xylS gene having the synthetic promoter, optimized ribosome binding site and 5' UTR hairpin structure is more efficiently expressed than the native xylS gene and therefore is more effective at stimulating transcription of the K4 chondroitin biosynthesis genes by the Pm promoters. The chromosomal strains MSC467 and MSC466 do not contain any plasmids carrying the K4 chondroitin biosynthesis genes, or the regulatory xylS gene, and are both capable of production of substantial quantities of chondroitin.

TABLE 8E

| Strain | m-TA (mM) | chondroitin (μg/mL) | OD, A600 |
|---|---|---|---|
| MSC466 | 0 | 171 | 15.5 |
|  | 1 | 496 | 15.6 |
|  | 2 | 456 | 15.6 |
|  | 4 | 419 | 15.6 |
| MSC467 | 0 | 163 | 14.7 |
|  | 1 | 460 | 15.5 |
|  | 2 | 450 | 15.1 |
|  | 4 | 325 | 13.7 |

MSC467 contains the tetracycline-resistance gene derived from pDD74 (see FIG. 8L) inserted in the chromosome immediately downstream (3') of the kpsS gene of the chromosomal K4 gene cluster. (See FIG. 8T) In order to allow use of tetracycline-resistance encoded by plasmid-borne genes as a selection for the introduction and maintenance of certain plasmids, this chromosomal tetracycline-resistance gene was deleted from the chromosome of MSC467, as detailed below, using the "pop in/pop out" procedure described in Example 3. The resulting tetracycline-sensitive derivative of MSC467 was designated MSC561. Construction of MSC561 was accomplished as follows.

Approximately 900 base pairs of chromosomal sequence immediately upstream of the tetR gene in MSC467 and pDD74 were amplified using pDD74 DNA as template and primers BLR476 and BLR478:

```
BLR476
                              (SEQ ID NO: 101)
5> CGTCAAGCTTGTGAACGCCTATAGCAGCTTG >3

BLR478
                              (SEQ ID NO: 102)
5> CAGTGGCGCGCCGAGCGATGATAAGCTGTC >3
```

The resulting PCR product was digested with HindIII and AscI and ligated with pMAK-CL (described in Example 3 and FIG. 8L) plasmid DNA that had been digested with HindIII and AscI and treated with Antarctic Phosphatase (New England BioLabs, Ipswich, Mass.) according to the vendor protocol. Ligation products were transformed into *E. coli* NEB5α (New England BioLabs, Ipswich, Mass.), and plasmid DNAs from resulting transformants were screened for the presence of the cloned PCR fragment by diagnostic restriction endonuclease digestions. The recombinant plasmid from one such transformant was designated as pBR1087 and used in gene replacement experiments to delete the tetR gene from the MSC467 chromosome. The structure of pBR1087 is diagrammed in FIG. 8U. This plasmid was transformed into MSC467 with selection for chloramphenicol-resistance at 30° C., the permissive temperature for replication of the pMAK705-based replicon. Cultures grown at 30° C. were subsequently plated at 43° C. in the presence of chloramphenicol at 34 μg/mL ($Cm^{34}$), and resulting colonies were picked and streaked onto LB+$Cm^{34}$ plates at 43° C. Resulting colonies were screened by PCR for the integration of pBR1087 at the targeted locus, and isolates that were identified as containing the plasmid sequences integrated at this locus were sub-cultured in LB liquid medium at 30° C. in the absence of chloramphenicol. Subsequently, isolates thus sub-cultured were plated on LB at 30° C. in the absence of chloramphenicol, and resulting colonies were tested for sensitivity to chloramphenicol and tetracycline. Chloramphenicol-sensitive, tetracycline-sensitive derivatives, the presumptive gene replacement strains in which the tetR gene has been deleted as a result of excision of the integrated plasmid, were obtained and screened by PCR to confirm this presumptive chromosomal structure.

Figure 8T:
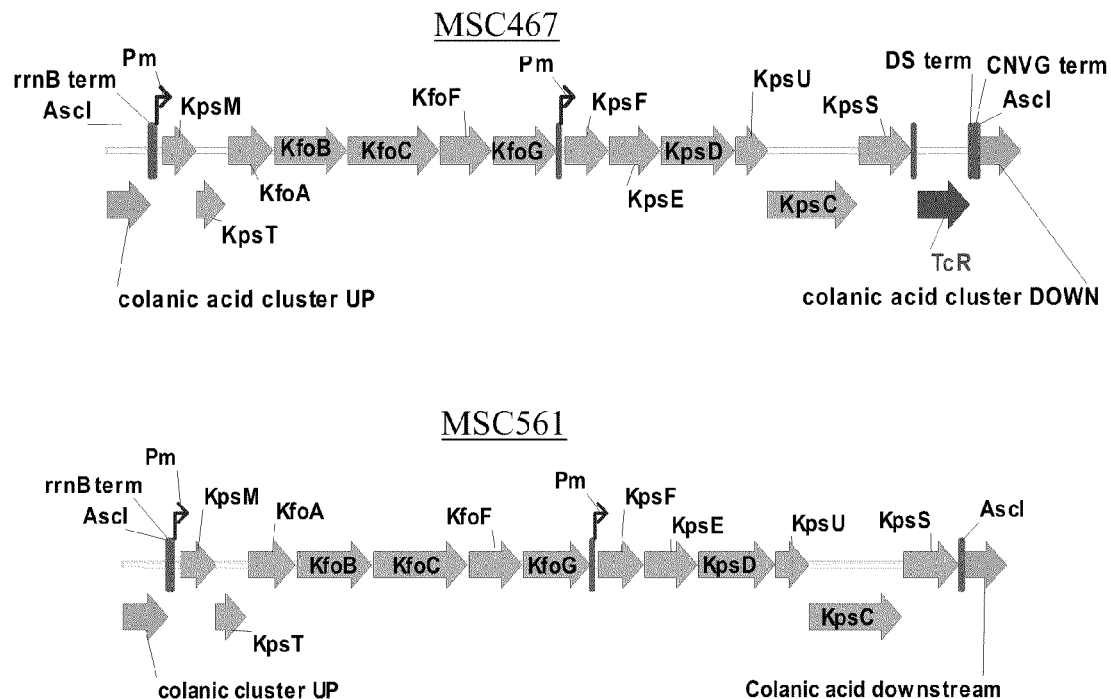
Figure 8U:
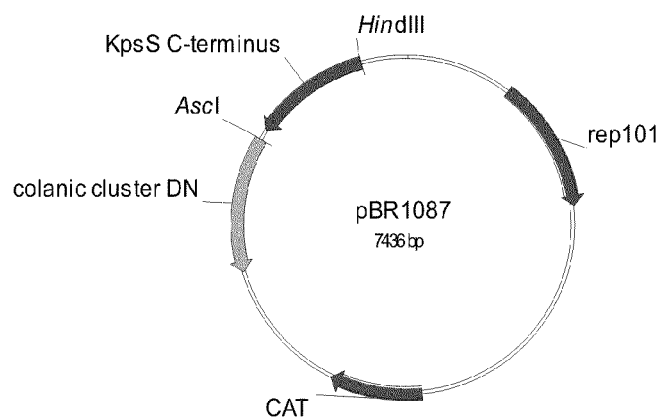

One strain that was thus identified as having undergone deletion of the tetR gene was designated as MSC561 and the structure of the chromosomal K4 gene cluster of MSC561 is shown in FIG. 8T. The deletion extends from 71 bp downstream of the kpsS coding sequence up to the AscI site at the 5' end of the sequences downstream of the colanic acid locus. The deletion includes the entire tetR gene.

Example 11

This Example Demonstrates that Increasing the Gene Dosage of the K4 Region 2 Genes (kfoABCFG) Relative to the Regions 1 and 3 Genes Results in Significantly Greater Chondroitin Production in *E. coli* K-12 Shake Flask Cultures

*E. coli* K-12 strain MSC467 (Example 10) contains regions 1, 2, and 3 at the colanic acid locus under control of the Pm promoter and xylS at the fhuA locus under control of the synthetic consensus promoter. Plasmid pCX039 (Example 4) contains the region 2 kfoABCFG genes under control of the Pm promoter and also contains the native xylS gene. pCX039 was transformed into MSC467 to create strain MSC499. Control strain MSC498 was created by transforming pDD63 (Example 4) into MSC467. Chondroitin production in shake flask cultures (TB/Cm$^{34}$ medium, 30° C., 72 hr) with variable inducer concentrations was determined for these two strains. (Table 9A).

TABLE 9A

| Strain | Strain description | m-TA | CH; μg/mL |
|---|---|---|---|
| MSC498 | MSC467 + pDD63 (xylS; no K4 genes) | 0 | 109 |
| | | 1 mM | 349 |
| | | 2 mM | 342 |
| | | 3 mM | 359 |
| MSC499 | MSC467 + pCX039 (xylS; kfoABCFG) | 0 | 760 |
| | | 1 mM | 1067 |
| | | 2 mM | 916 |
| | | 3 mM | 951 |

Increasing the region 2 gene dosages by presenting them on a plasmid clearly resulted in higher chondroitin production. A relatively high level of production was seen in strain MSC499 without induction. This was likely due to uninduced expression of the K4 genes due to enhanced expression of the modified xylS gene present in the MSC499 chromosome. As noted above, it is known that high levels of XylS protein can activate the Pm promoter even in the absence of added inducer (Dominguez-Cuevas et al., 2008). To determine whether additional plasmid-encoded XylS is required for optimal chondroitin production in this plasmid system, derivatives of plasmids pDD63 and pCX039 lacking xylS genes were constructed. These plasmids each contain two Nsi I restriction sites that flank the entire xylS gene coding sequence within 1049 bp fragments (see Example 4). Samples of these plasmids were digested with NsiI, heat-treated to inactivate the enzyme, and then treated with T4 DNA ligase to generate circular plasmids lacking the xylS gene fragment. The pDD63ΔNsi was first transformed into *E. coli* MSC188 (Example 3). The characterized pDD63ΔxylS plasmid was named pCX069. This plasmid was subsequently transformed into *E. coli* MSC467 (Example 10) to create strain MSC510. The pCX0394Nsi sample was transformed directly into MSC467, and the characterized ΔxylS plasmid was named pCX074. Chondroitin production by these strains plus the MSC498 and MSC499 control strains was determined as described previously in this Example, and the results are shown in Table 9B.

TABLE 9B

| strain | plasmid | m-TA | CH; μg/mL |
|---|---|---|---|
| MSC498 | MSC467 + pDD63 (xylS; no K4 genes) | 1 mM | 338 |
| | | 2 mM | 358 |
| MSC499 | MSC467 + pCX039 (xylS; kfoABCFG) | 1 mM | 1024 |
| | | 2 mM | 964 |
| MSC510 | MSC467 + pCX069 (pDD63ΔxylS) | 1 mM | 310 |
| | | 2 mM | 359 |
| MSC511 | MSC467 + pCX074 (pCX039ΔxylS) | 1 mM | 874 |
| | | 2 mM | 1135 |

Deletion of xylS from pCX039 did not reduce the maximal amount of chondroitin produced but a higher inducer level was needed to achieve the maximal level; see MSC511 vs. MSC499 in Table 9B. This result illustrates the interrelatedness of XylS levels, inducer levels, K4 gene complement, and chondroitin productivity.

Example 4 above describes the derivation of plasmid pDD80, a pMAK705-based replacement plasmid designed for insertion of xylS and the region 2 kfoABCFG genes, all expressed from the synthetic consensus promoter, into the *E. coli* chromosome at the fhuA locus. Table 9C below describes chondroitin production in MSC467 (chromosomal xylS) and MSC392 (no xylS) strains (Example 10) containing pDD80 as an extra-chromosomal element.

TABLE 9C

| Strain | Strain Description | m-TA | CH; μg/mL |
|---|---|---|---|
| MSC499 | MSC467 + pCX039 (xylS; kfoABCFG) | 0 | 410 |
| | | 1 mM | 897 |
| MSC522 | MSC467 + pDD080 (xylS/kfoABCFG) | 0 | 997 |
| | | 1 mM | 896 |
| MSC526 | MSC392 + pDD080 (xylS/kfoABCFG) | 0 | 868 |
| | | 1 mM | 968 |

Similar to the cases with pCX039, plasmid pDD80 enhanced chondroitin production in *E. coli* host strains containing chromosomal copies of the entire complement of K4 chondroitin biosynthesis genes (regions 1, 2, and 3). Induction had little effect on chondroitin production in strains containing pDD80, regardless of the presence or absence of xylS copies in the chromosome. This is likely a result of a relatively high level of XylS in these strains due to expression, from a multicopy plasmid, of the modified xylS gene driven by the strong synthetic promoter, and containing the optimized ribosome binding site and hairpin structure added to the mRNA 5-prime end.

Example 12

This Example Demonstrates that the Addition of a Single Additional Copy of the kfoABCFG Genes to the Chromosome of Strain MSC467 Increases Chondroitin Production Example 11 above demonstrates that chondroitin production by strain MSC467 in shake flasks was greatly enhanced when extra copies of the K4 region 2 genes kfoABCFG under control of the Pm promoter were introduced into MSC467 on plasmid pCX039. Similar results were obtained when plasmid pDD80 was introduced into MSC467. Plasmid pDD80, described in Example 4 carries the kfoABCFG genes under transcriptional control of the synthetic xylS promoter described in Example 10 above. These results indicate that increasing the levels of one or more of the proteins encoded by the kfoABCFG genes significantly increases chondroitin production. Cloning of these genes on a multi-copy plasmid provides one method for increasing the production of these proteins. An alternative method for increasing the production of these proteins, without employing a plasmid expression platform, is to insert multiple copies of these genes into the chromosome of the host organism.

A second copy of the kfoABCFG gene set was inserted into the chromosome of the MSC467 at the fhuA locus, immediately downstream of the modified xylS gene, under transcriptional control of the synthetic xylS promoter. A replacement vector was constructed for this purpose by cloning the kfoABCFG genes on a PstI fragment excised from pCX039 into the compatible NsiI site of pDD79 as detailed in Example 4. In the resulting plasmid, pDD80, the kfoABCFG genes are transcribed by the synthetic xylS promoter which was designed to be a strong constitutive promoter. pDD80 was transformed into MSC467 to produce strain MSC522 which was shown in Example 10 above to produce approximately 1 g/L chondroitin in shake flasks. A replacement strain (MSC537) was derived from MSC522 via procedures for pMAK705-based plasmid replacements as detailed in Example 3 and Example 10 above. This strain carries one additional copy of the kfoABCFG genes inserted at the fhuA locus, immediately downstream of the xylS gene, in the MSC467 chromosome.

MSC537 was tested in parallel with MSC467 for chondroitin production. Cultures were inoculated at approximately 0.01 OD A600 in TB medium at 30° C. At an OD of approximately 0.10, cultures were induced by addition of 1 mM m-TA and cultured for an additional 72 hours. Samples were taken for chondroitin assays at 48 and 72 hours post-induction. At 72 hours post-induction, MSC537 produced 0.57 g/L chondroitin while MSC467 gave 0.45 g/L; an increase of approximately 25% for MSC537 vs. MSC467. In further experiments, when MSC537 and MSC467 were tested in parallel for chondroitin production in shake flasks, MSC537 consistently produced more chondroitin (20-30%) than MSC467. This result indicates that the addition of a single additional copy of the K4 region 2 genes kfoABCFG to the MSC467 chromosome can increase chondroitin production although not to the same extent that the addition of multiple copies of the kfoABCFG genes increases chondroitin production in strains MSC499 and MSC522. These two strains, which carry the cloned kfoABCFG genes on multi-copy plasmids, produce approximately 2-fold more chondroitin than MSC467 (see Example 10). The plasmid pCX039 was transformed into MSC537 to create strain MSC551.

Like MSC467, the MSC537 strain contains the tetracycline-resistance gene derived from pDD74 (see FIG. 8L) inserted in the chromosome immediately downstream (3') of the kpsS gene of the chromosomal K4 gene cluster present in MSC537. As noted above, in some embodiments it is desirable for strains to be tetracycline-sensitive. Therefore, the tetR gene was deleted from the chromosome of MSC537 using the same procedures, and replacement plasmid (pBR1087) as described above in Example 10 for deletion of the tetR gene from the chromosome of MSC467. The resulting tetracycline-sensitive derivative of MSC537 was designated MSC562. In a shake flask experiment, MSC562 and MSC537 were grown in TB medium at 30° C. and induced by addition of 1 mM m-TA. Chondroitin titers of culture samples harvested at 72 hours post-induction were determined and found to be comparable to each other; 0.51 g/L for MSC562 vs. 0.57 g/L for MSC537.

Plasmids pCX039, which contains the kfoABCFG genes as shown in FIG. 8Q, and pDD63, the vector-only control plasmid shown in FIG. 8I, were transformed into strain MSC562 to create strains MSC564 and MSC563, respectively. In shake flasks experiments, MSC563 and MSC564 were grown at 30° C. in TB medium containing tetracycline (5 µg/mL) for plasmid selection and induced with 1 mM m-TA. At 72 hours post-induction, cultures of MSC564 and MSC563 produced chondroitin at titers of 0.81 g/L and 0.29 g/L, respectively.

In this experiment, in which cultures were grown in the presence of tetracycline, plasmid retention of pCX039 in MSC564 was very efficient. A sample from the 72 hour culture of MSC564 was diluted and plated on LB plates and LB plates containing 5 µg/mL tetracycline. The titers of colony forming units (CFU) were not significantly different under these two plating conditions; $1.16 \times 10^9$ CFU/mL on LB vs. $1.28 \times 10^9$ CFU/mL on LB+tetracycline. Thus, under the conditions of this experiment, no loss of the plasmid was detected.

It is expected that subsequent additions of more copies of the kfoABCFG genes to the chromosome of MSC537 will further increase chondroitin production in this strain. Additional copies of these genes can be inserted at other chromosomal loci using the gene targeting procedures detailed in Example 3. A wide variety of non-essential loci are known in *E. coli* which could serve as additional sites for integration of these genes. In addition, tandem arrays, consisting of two or more copies of the kfoABCFG gene set, could be constructed on gene replacement plasmids and introduced into the chromosome in a single gene replacement event.

Moreover, additional methods for increasing the production of the proteins encoded by the kfoABCFG genes include codon optimization of protein coding sequences, and optimization of the sequences of promoters, ribosome binding sites and 5-prime untranslated regions of mRNAs of these genes. Such sequence optimizations could be applied to genes that were expressed from plasmid vectors and to genes that were inserted into the chromosome.

Example 13

This Example Describes the Introduction of Chondroitin Biosynthesis Genes into *Xanthomonas campestris* Using Plasmid Vectors and Chromosomal Integration, and Demonstrates Recombinant DNA Mediated Chondroitin Biosynthesis in *Xanthomonas campestris* in Shake Flasks Specifically, described herein is the construction of plasmids containing combinations of the K4 biosynthetic genes and their introduction into *Xanthomonas campestris* strain MSC255. Further described is the use of derivatives of plasmids pKM001 and pKM002 (described in Example 3) to stably insert the chondroitin biosynthetic genes and subsets thereof into the *X. campestris* strain MSC255 chromosome at the site of the deletion of the xanthan gum operon.

Introduction of Chondroitin Biosynthetic Genes into *X. campestris* as Extra-chromosomal Elements The present inventors have discovered that introduction of large plasmids into *X. campestris* directly from *E. coli* donors (e.g., via tri-parental crosses) or as plasmid purified from *E. coli* strains (e.g., via electroporation—see below) can result in structural anomalies in the resulting plasmid in *X. campestris*. Relatively small plasmids appear less sensitive to this phenomenon, which may be due to restriction systems native to *X. campestris* (Feyter and Gabriel, *J. Bact.* 1991; 173: 6421-6427, da Silva et al., *Nature* 2002; 417:459, Roberts et al., *Nuc. Acid Res.* 2010; 38:D234) that have a relatively greater effect on larger DNA molecules. The present inventors have used two approaches that successfully overcome this effect. In one approach, a large plasmid encompassing regions 1, 2, and 3 genes was reconstructed from smaller plasmids purified from *X. campestris* transformants. In a second approach, the regions 1, 2, and 3 genes were split between two (smaller) compatible plasmids.

Figure 10B:
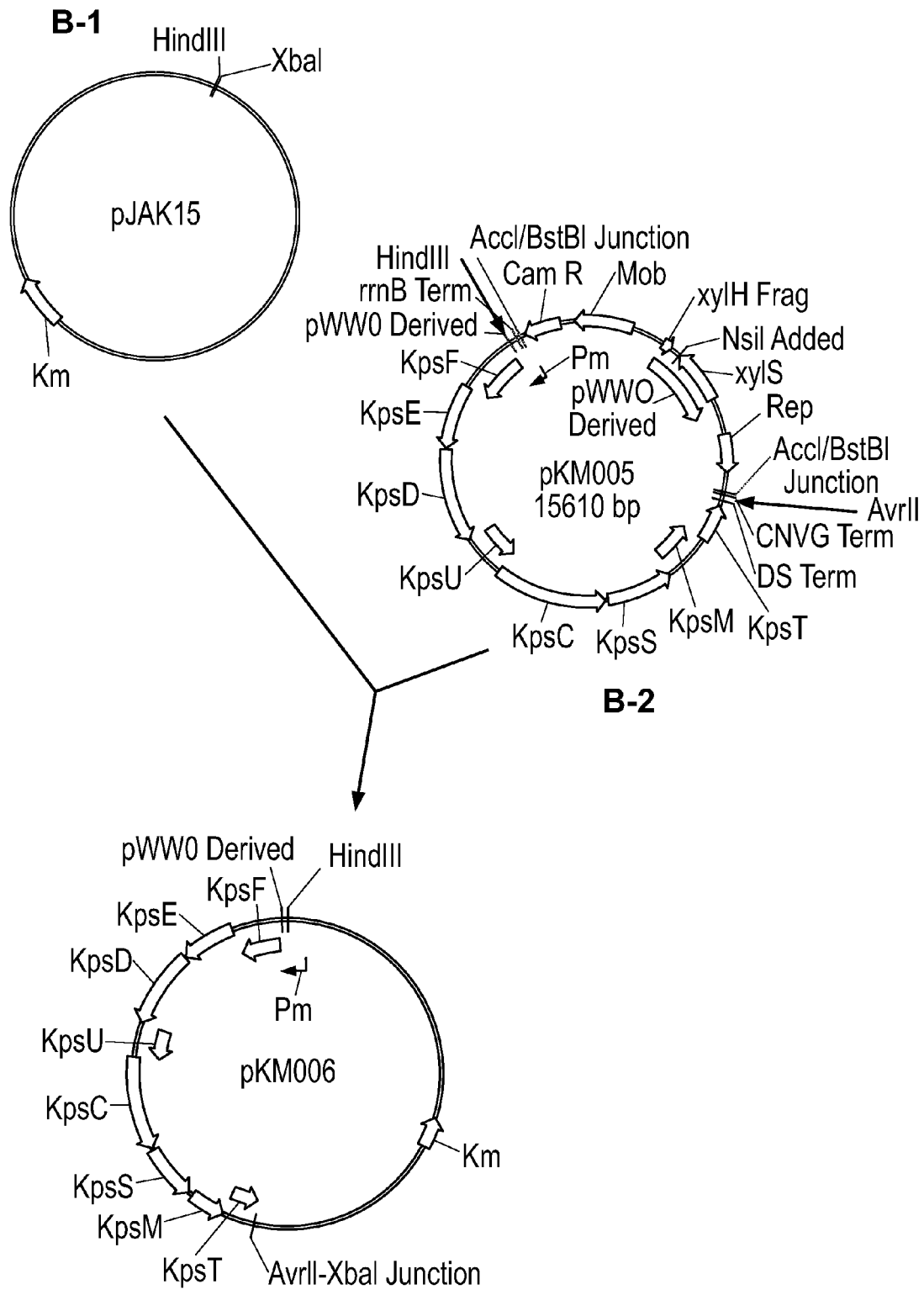
Figure 10C:
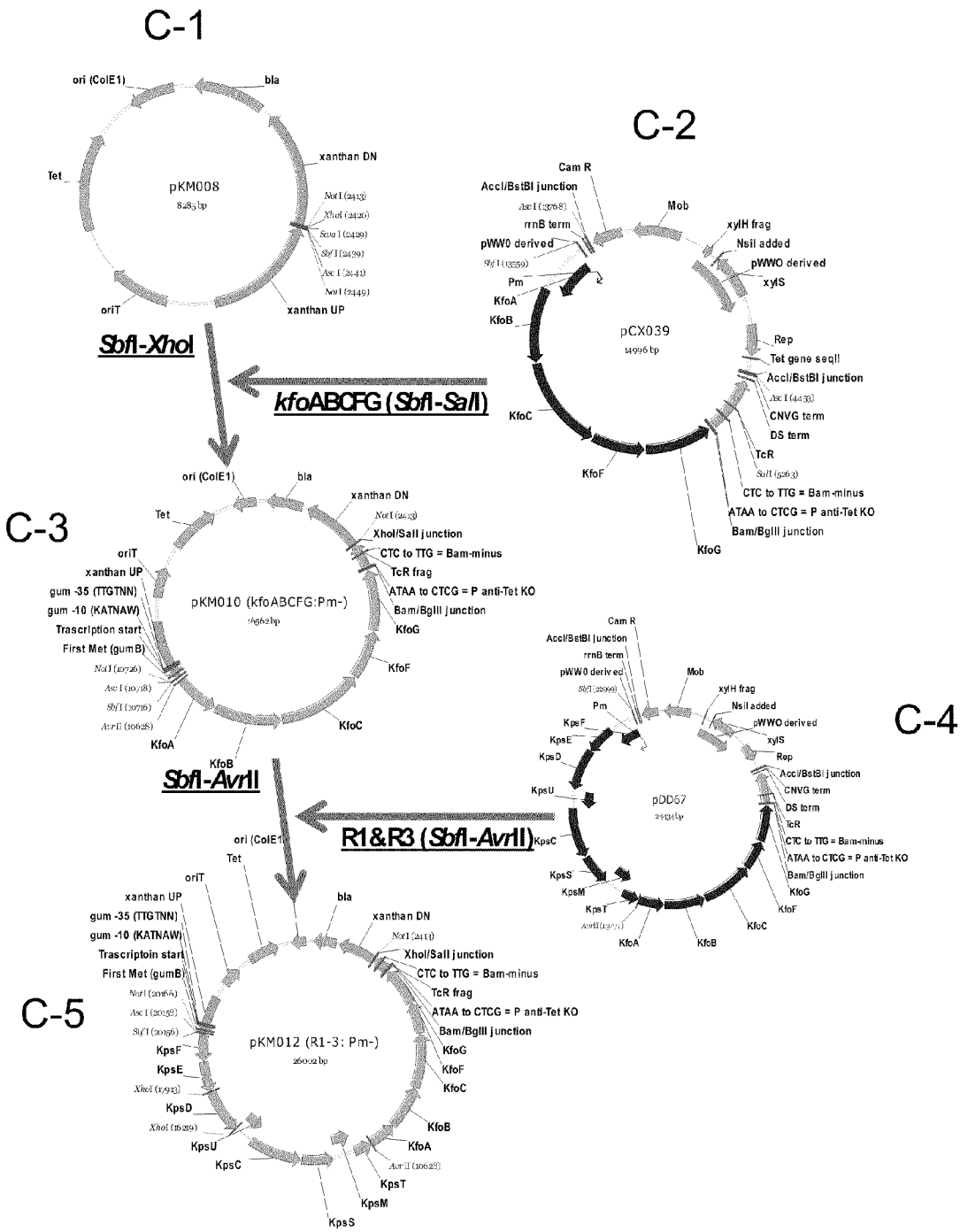
Figure 10D:
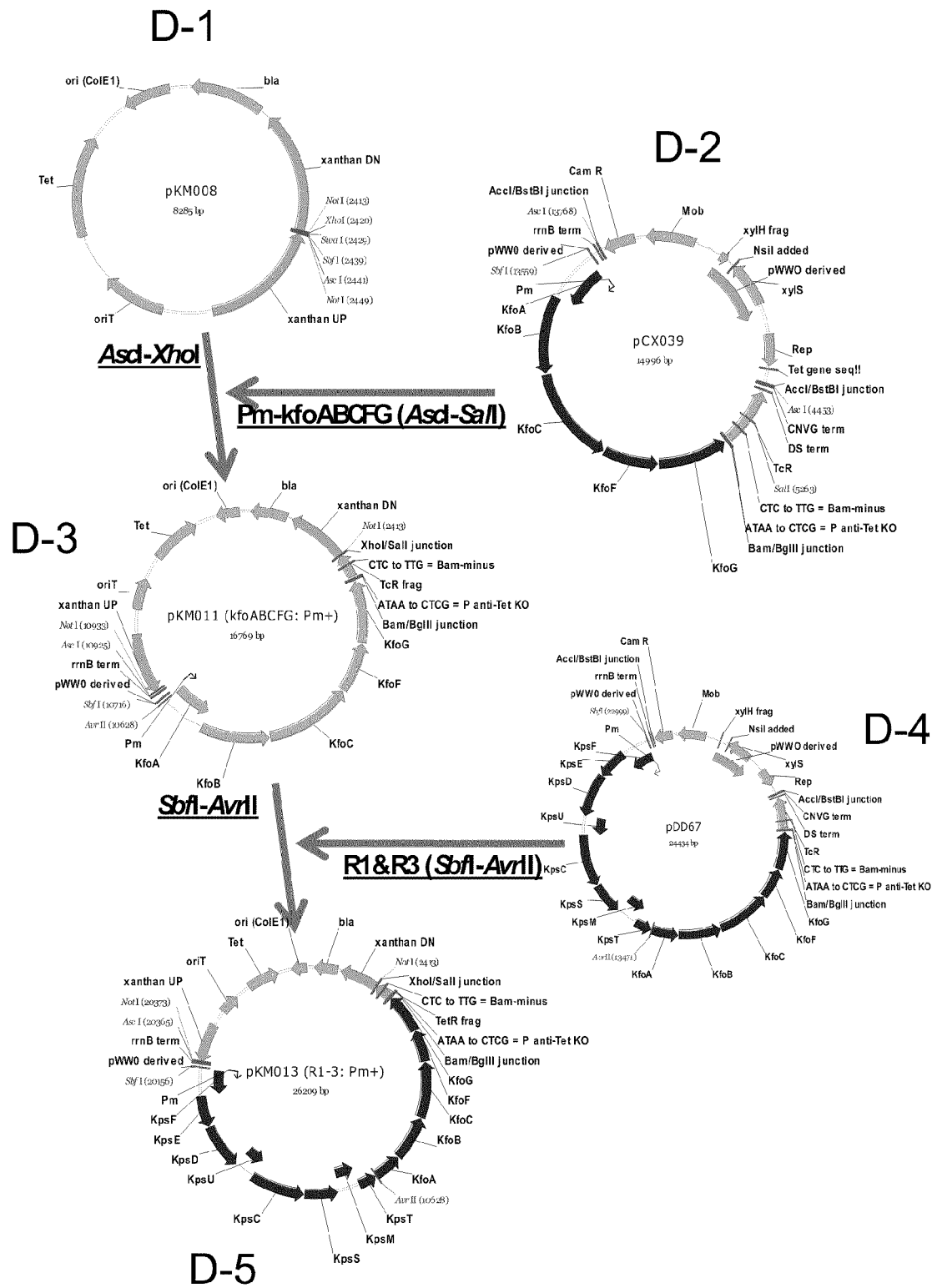

Electroporation was used to introduce plasmids into *X. campestris* cells (Oshiro et al, *J. Microbiol. Method* 65:171-179, 2006). Plasmid pDD67 (described in Example 4) was digested with restriction enzymes BamHI and RsrII (which bound the region 2 genes) followed by reaction with T4 DNA polymerase (to create blunt ends) and ligation. The resulting mix was transformed into *E. coli*, and tetracycline-resistant isolates were characterized. The resulting plasmid, pKM005, shown in FIG. 10A, containing Pm-driven regions 1 and 3 genes, was then transformed by electroporation into *X. campestris* to create strain MSC338. Likewise, pCX039 (Example 4) was transformed into *X. campestris* to create MSC326. Plasmids pKM005, purified from MSC338, and pCX039, purified from MSC326, were each digested with HindIII plus AvrII, and the region 1, 3 fragment from pKM005 was ligated with the vector/region 2 fragment of pCX039. The resulting mix was transformed directly into MSC255 with selection for tetracycline-resistance. One *X. campestris* transformant, MSC348, was shown to contain the plasmid pKM007 (FIG. 10A) which was indistinguishable from pDD67 by restriction digests of plasmid that had been transferred back to *E. coli*. For control purposes, *X. campestris* strain MSC255 was transformed with pDD63 vector to create strain MSC397.

Plasmid pJAK15 (ATCC77290, obtained from ATCC) belongs to the IncQ incompatibility group and encodes kanamycin resistance. The HindIII/AvrII fragment from pKM005 (containing the Pm-driven regions 1 and 3; see above) was ligated with the vector/kanamycin resistance HindIII XbaI fragment from pJAK15. The resulting plasmid, pKM006, as shown in FIG. 10B, contains inducible regions 1 and 3 genes on a vector compatible with the various pBHR1-derived plasmids. Strain MSC326 (MSC255 pCX039) was transformed with pKM006 with simultaneous selection for kanamycin and tetracycline resistance to create strain MSC350.

The knock-out vectors pKM001 and pKM002 were first modified by introduction of a short DNA oligonucleotide linker that carries AscI, SbfI, SwaI and XhoI cloning sites into the NotI restriction sites that define the junctions of the upstream and downstream regions of homology in pKM001 and pKM002. The linker was made from annealed oligonucleotides prKM015 and prKM016 such that single-strand overhangs were present that are compatible with those generated by NotI digestion of pKM001 and pKM002. The resulting plasmids, designated pKM008 and pKM009 respectively, contain the linker oriented such that the AscI restriction sites are proximal to the upstream regions.

```
prKM015 (5'-3')
                                   (SEQ ID NO: 99)
          AscI           SwaI  XhoI
GGCCGCGGGCGCGCCTGCAGGATTTAAATCTCGAGGC prKM016 (3'-5')
                                  (SEQ ID NO: 100)
CGCCGCGCGGACGTCCTAAATTTAGAGCTCCGCCGG
            SbfI
```

Replacement vectors having only the K4 region 2 genes (kfoA, kfoB, kfoC, kfoF and kfoG) were constructed as follows: pKM008 was digested with SbfI-XhoI or AscI-XhoI and pCX039 was digested with SbfI-SalI or AscI-SalI. SbfI-SalI treatment produces a kfoABCFG-containing fragment from pCX039 and AscI-SalI treatment produces a Pm promoter-kfoABCFG-containing fragment. These fragments were cloned into pKM008 which was first digested with SbfI-XhoI or AscI-XhoI to generate plasmids pKM010 (kfoABCFG: Pm−) and pKM011 (kfoABCFG: Pm+) respectively. Plasmids pKM010 (SEQ ID NO:145) and pKM011 (SEQ ID NO:146) were used to construct additional replacement vectors that also incorporate the K4 region 3 (kpsF, kpsE, kpsD, kpsU, kpsC and kpsC) and region 1 (kpsM and kpsT) genes. pKM010 and pKM011 were digested with SbfI-AvrII and these linearized vectors were ligated with the kpsFEDUCSMT-containing fragment produced by SbfI-AvrII digestion of pDD67. The resulting plasmids were designated pKM012 (Pm−) and pKM013 (Pm+). Derivation of plasmids pKM010 (SEQ ID NO:145) and pKM012 (SEQ ID NO:147) is diagrammed in FIG. 10C. Derivation of plasmids pKM011 (SEQ ID NO:146) and pKM013 (SEQ ID NO:148) is diagrammed in FIG. 10D.

The upstream region of the xanthan gum gene cluster, which is cloned in all of the pKM008-pKM013 constructs, is reported to encompass the gum gene cluster promoter (Federico et al; *J. Bact.* 1996; 178:4313-4318). Therefore, *X. campestris* strains that contain sequences derived from pKM010 or pKM012 recombined into the chromosome are expected to transcribe the K4 genes from the endogenous gum promoter. In contrast, pKM011 and pKM013 have terminator sequences (derived from pDD67) located between the gum promoter and the Pm promoter. Therefore, the expression of K4 genes in recombinant *X. campestris* containing pKM011 or pKM013 sequences is expected to be regulated by the Pm/XylS system.

For each of these replacement plasmids, the "pop-in/pop-out" methodology (detailed above) was used to recombine the respective K4 gene clusters into the chromosome of *X. campestris* strain MSC255 at the (deleted) gum locus. The plasmids were introduced into MSC255 by electroporation with selection for tetracycline resistance. Intermediate and final strains are indicated in Table 10A below. Recombinants in which the "pop-in" has taken place at the gum locus were identified by PCR. Resolution of the integrants was allowed to occur by culturing in the absence of antibiotic selection, and tetracycline sensitive ("pop-out") derivatives were subsequently identified. PCR was then used to identify the "pop-out" derivatives in which the respective K4 gene clusters have successfully integrated into the gum locus in the desired orientation. Plasmid pDD63 (carrying the xylS inducer gene) was then transformed into the recombinants in which the Pm promoter is driving the K4 gene sets. The genetic structure of the four key *Xanthomonas* chromosomal insertion strains (containing no plasmid-encoded K4 genes), MSC480, MSC469, MSC461, and MAC494, is summarized in Table 10A.

TABLE 10A

| Replacement plasmid | Promoter | K4 genes | "pop-in" strain | "pop-out" strain | pDD63 (xylS) transformant |
|---|---|---|---|---|---|
| pKM010 | gum | kfoABCFG | MSC435 | MSC480 | — |
| pKM011 | Pm | kfoABCFG | MSC441 | MSC455 | MSC469 |
| pKM012 | gum | kpsFEDUCS kpsMT kfoABCFG | MSC466 | MSC461 | — |
| pKM013 | Pm | kpsFEDUCS kpsMT kfoABCFG | MSC448 | MSC493 | MSC494 |

Chondroitin Production in Shake Flasks of Recombinant *Xanthomonas campestris*

Unless otherwise stated, growth of *X. campestris* strains in shake flasks for evaluation of chondroitin production was conducted in YMG medium (5 g/L proteose peptone, 3 g/L yeast extract, 3 g/L malt extract, 10 g/L glucose). Cultures were routinely grown at 30° C. in 50 mL medium in a 250 mL growth flask at 200-225 rpm with the required antibiotics for selection (e.g., 2-5 μg/mL tetracycline, 10 μg/mL kanamycin) for 48 hr. For induction of Pm-driven gene sets, 2 mM m-TA was added when culture densities reach approx. OD600=0.5.

Strains with extra-chromosomal K4 biosynthetic genes. Chondroitin production in *Xanthomonas campestris* strain MSC255 (ΔgumB-gumM) transformed with various plasmids was determined by culturing and assaying as described above. Results are shown in Table 10B.

TABLE 10B

| Strain | Plasmids | K4 genes | Culture age (hr) | OD600 | CH (μg/mL) |
|---|---|---|---|---|---|
| MSC397 | pDD63 | — | 48 | 5.44 | nd* |
| MSC326 | pCX039 | region 2 | 48 | 1.53 | 104 |
| MSC348 | pKM007 | all | 48 | 2.49 | 37.2 |
| MSC350 | pCX039 pKM006 | all | 41 | 2.16 | 41.2 |

*none detected

The control strain MSC397, containing the empty vector, made no detectable chondroitin. Strains MSC348 and MSC350, containing the regions 1, 2, and 3 genes, produced about 40 μg/mL chondroitin under these conditions. Strain MSC326, containing just the region 2 genes, produced about 100 μg/mL chondroitin.

In another experiment, chondroitin production in strain MSC326 (MSC255 pCX039) containing the kfoABCFG genes was 166 μg/mL after 48 hr; control strain MSC397 (MSC255 pDD63—vector control) produced no detectable chondroitin. In fractions from non-autoclaved samples of the MSC326 culture, the cell-free supernate and cell pellet fractions contained 100 μg/mL and 71 μg/mL chondroitin, respectively. These results show that the K4 region 2 genes (minus those directing fructosylation) are sufficient for chondroitin production in X. campestris and further suggest that the chondroitin is being exported from the cells by some uncharacterized endogenous mechanism or by cell breakdown or lysis.

Strains with chromosomally encoded K4 biosynthetic genes. The extra-chromosomal plasmids described above are, with varying frequencies, lost from bacterial cells in culture as defined by loss of antibiotic resistance. Integration of the K4 biosynthetic genes into the X. campestris chromosome should minimize such instability as well as facilitate large scale culturing of these strains. Chondroitin production in the four strains with chromosomally integrated K4 genes (see above) is shown in the Table 10C below. The strains were grown in either modified YMG medium (YMGM(5): YMG buffered with 80 mM MOPS (pH 7.0), 5 g/L glucose) or TB medium for 48 hours. Tetracycline is present at 5 μg/mL in strains with pDD63. Chondroitin was produced from both promoters and in both media. Significantly, chondroitin was produced when only the region 2 genes are present. See table 10C.

TABLE 10C

| Strain | Promoter | K4 genes | Medium | mTA inducer | chondroitin (μg/mL) |
|---|---|---|---|---|---|
| MSC480 | Gum | region 2 | YMGM (5) | none | 97.5 |
| MSC480 | Gum | region 2 | TB | none | 117 |
| MSC469 | Pm (+pDD63) | region 2 | YMGM (5) | 2 mM | 316 |
| MSC469 | Pm (+pDD63) | region 2 | TB | 2 mM | 297 |
| MSC461 | Gum | all | YMGM (5) | none | 80.8 |
| MSC461 | Gum | all | TB | none | na* |
| MSC494 | Pm (+pDD63) | all | YMGM (5) | 2 mM | 108 |
| MSC494 | Pm (+pDD63) | all | TB | 2 mM | 122 |

*not assayed

In another experiment, selected strains were grown in YMGM medium with varying glucose levels. Chondroitin was produced at all glucose concentrations in strains carrying sets of the biosynthetic genes (but not in a control strain lacking such genes). The greatest production under these conditions was 390 μg/mL in strain MSC469 containing just the region 2 genes under control of Pm/xylS induction. Assay of the non-autoclaved cell-free supernate and cell pellet of the YMGM+10 g/L glucose culture of MSC469 found 167 μg/mL and 150 μg/mL chondroitin, respectively. As before, these results suggest that the chondroitin is being exported from the cells. See Table 10D.

TABLE 10D

| Strain | Promoter | K4 genes | Medium | Glucose (g/L) | mTA inducer | OD600 | chondroitin (μg/mL) |
|---|---|---|---|---|---|---|---|
| MSC255 | — | — | YMGM | 10 | none | 4.660 | nd* |
| MSC461 | Gum | all | YMGM | 5 | none | 2.492 | 69.2 |
| MSC461 | Gum | all | YMGM | 10 | none | 2.353 | 62.5 |
| MSC461 | Gum | all | YMGM | 20 | none | 2.278 | 72.9 |
| MSC469 | Pm (pDD63) | region 2 | YMGM | 5 | 2 mM | 3.515 | 390.2 |
| MSC469 | Pm (pDD63) | region 2 | YMGM | 10 | 2 mM | 3.586 | 367.4 |
| MSC469 | Pm (pDD63) | region 2 | YMGM | 20 | 2 mM | 2.893 | 246.7 |

*none detected

Example 14

This Example Describes the Methods for Assaying Fructosylated and Unfructosylated Chondroitin Preparation of Chondroitin from Bacteria Recombinant chondroitin (rCH) was captured using an anion-exchanger DEAE-cellulose DE52 column. After washing with 5 volumes of 100 mM NaCl, the column was eluted with 5 volumes of 300 mM NaCl. The eluate was concentrated and dialyzed against 10 volumes of distilled water. The dialyzed solution was lyophilized. The lyophilized powder was used as rCH.

Fructosylated chondroitin capsular polysaccharide (K4P) was purified from the culture of strain U1-41 (*Escherichia coli* O5:K4:H4) according to the method of Manzoni, M. et al. (*Biotechnology Letters* 1996; 18:383-386). Preparation of defructosylated K4P (DFK4P) from K4P was performed according to the method of Lidholt, K., et al. (*J. Biol. Chem.* 1997; 272: 2682).

Sample Preparation and Chondroitin Assay by HPLC

Flask culture samples (typically 5 mL) were autoclaved at 121° C. at >15 psi for 5 min. and allowed to cool. Samples were then re-adjusted to the original volume with water as needed to account for losses during autoclaving. Samples (1.5-5 mL) were centrifuged (typically 3500 g for 10 min. for lower cell density flask cultures; 12000 g for 5 min. for fermentation or higher density cultures) to yield supernate and pellet fractions. In some cases, as indicated, samples were centrifuged without prior autoclaving. Culture samples or separated supernates and pellets were usually stored at −20° C. until assayed.

For analysis of cell-associated chondroitin, cell pellets were resuspended in an original volume of 50 mM sodium phosphate buffer pH 7.2 and hydrolyzed with 5-10 mg/mL lysozyme (Sigma L-7651) and 60 U/mL deoxyribonuclease I (Sigma D-4527) at 37° C. for 2 hr followed by 200 µg/mL proteinase K (Promega V3021) at 37° C. for 1 hr. After terminating the reaction (90° C., 5 min), the solutions were centrifuged to remove cell debris.

For analysis of fructosylated chondroitin capsular polysaccharide (K4P), samples (flask/fermentation broth supernates or clarified hydrolyzed cell pellets) were first defructosylated using mild acid hydrolysis; i.e., adjusted with HCl to pH 1.5, incubated at 80° C. for 30 min. and then neutralized with 0.5 M sodium carbonate. Prior to lyophilization, the DFK4P samples and the non-fructosylated rCH samples (fermentation broth supernates, hydrolyzed cell pellets or reconstituted precipitates) were dialyzed overnight against deionized water (Pierce Biotechnology Slide-A-Lyzer®, molecular weight cut-off 7 kD) or partially purified by centrifugal ultra-filtration (Amicon Ultra-0.5 Centrifugal Filter Device, 10 kD nominal molecular weight cut-off) with elution in deionized water.

Chondroitin that is not fructosylated can be completely hydrolyzed to an unsaturated non-sulfated disaccharide, 2-acetamido-2-deoxy-3-O-(β-D-gluco-4-enepyranosyluronic acid)-D-galactose (Δdi-0S) by the chondroitin-degrading enzyme, which was named chondroitinase ABC (Seikagaku Biobusiness, Japan). Consequently, the amount of chondroitin in sample solutions that is not fructosylated can be determined by quantifying this disaccharide enzymatically produced from the polysaccharide using a HPLC system.

Figure 11A:
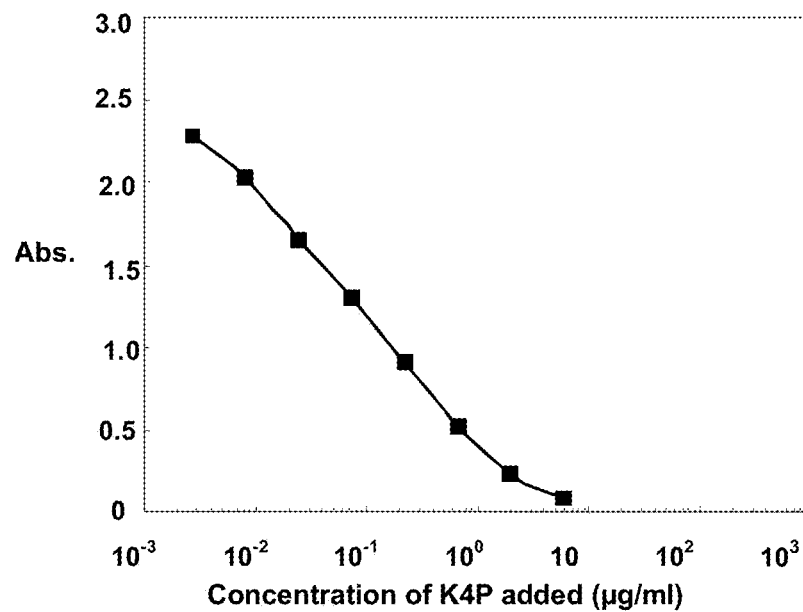
FIG. 11A shows a typical calibration curve for the K4 fructosylated chondroitin capsular polysaccharide ("K4P") measured in inhibitory ELISA.
Figure 11B:
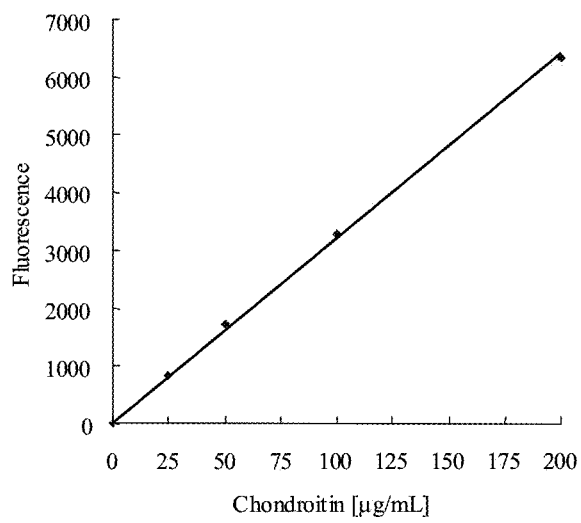
FIG. 11B shows a typical standard curve of the disaccharide, 2-acetamido-2-deoxy-3-O-(β-D-gluco-4-enepyranosyluronic acid)-D-galactose ("Δdi-0S"), measured in the chondroitinase/HPLC assay for chondroitin.

The residue after lyophilization was dissolved in THB (50 mM Tris-HCl buffer with 50 mM sodium acetate pH 8.0) and hydrolyzed with chondroitinase ABC (2 units/mL, 37° C. for 3 hr). After terminating the enzymatic reaction by heating at 90° C. for 5 min., the mixture was centrifuged at 10000 rpm for 5 min. to remove insoluble sediments. The supernatant was filtrated using Microcon centrifugal filter (Ultracel YM-10; Millipore) to remove enzyme and non-chondroitin polysaccharides. The resulting unsaturated disaccharide (2-acetamido-2-deoxy-3-O-(β-D-gluco-4-enepyranosyluronic acid)-D-galactose; Δdi-0S) was separated by reverse-phase ion-pair HPLC (Senshu Pak Docosil, 4.6×150 mm; particle size, 5 µm), labeled post-column with 2-cyanoacetamide, detected with fluorescence (Toyoda, H., et al. *J. Biol. Chem.*, 2000; 275:2269), and quantified against external standards prepared from commercially available chondroitin (Seikagaku Biobusiness, Japan) or rCH. The typical calibration curve for the disaccharide is shown in FIG. 11B. The calibration curve for the disaccharide was linear in the range of 2 to 200 µg/mL, and the detection limit of the disaccharide was 1 µg/mL. The concentration of the chondroitin polysaccharide can be calculated using the following formula, Concentration;µg/mL=[$A$]/[$S$]×[$D$], where [A] represents the peak area of Δdi-0S in the sample chromatogram, [S] represents the slope of calibration curve for Δdi-0S concentration and [D] represents the dilution factor.

ELISA Method for Quantification of Fructosylated Chondroitin

Biotinylation coupling through carboxyl groups of K4P was performed according to the method of Osmond, R. I. W. et al., *Analytical Biochemistry* 2002; 310: 199-207). 100 µl of biotinylated K4P (1 µg/ml) was conjugated to a streptoavidin coated 96-well micro-titer-plate (Thermo Scientific, Japan) at room temperature for 30 min. After washing the plate using 50 mM Tris-HCl buffered saline (NaCl 100 mM) supplemented with 0.05% TWEEN® 20 and 0.05% Proclin (pH 7.5). 50 µl of culture supernatant or standard K4P solution, and 50 µl of anti-K4P serum (Statens Serum Institut, Denmark) at a dilution of $2.5 \times 10^6$ were added to the wells and incubated for 60 min. After washing the wells again, HRP-labeled anti-rabbit immunoglobulins (P0448, DAKO JAPAN, Japan) at a dilution of 2000× was added and incubated for 60 min. After washing the wells again, TMB solution (TMBW-1000-01, BioFX Laboratories Inc., Owings Mills, Md.) containing $H_2O_2$ was added as substrate and incubated at room temperature for 30 min. 50 ml of Stop Reagent (STRP-1000-01, BioFX Laboratories Inc., Owings Mills, Md.) was added and the absorbance at 450 nm was measured. Under these assay conditions, other polysaccharides such as unfructosylated chondroitin, heparosan and DFK4P do not compete with K4P. A typical standard curve is shown in FIG. 11A.

SEC-HPLC Analysis of rCH, K4P and DFK4P

Weight average molecular weight ("Mw") and chondroitinase-digestibility of polysaccharides was determined by analyzing on a SEC-HPLC using an TOSOH HLC-8220GPC system equipped with a refractive index detector and tandem columns of TSK-gel PWXL-4000, PWXL-3000, and PWXL-2500 (TOSOH, Japan) at a constant flow rate of 0.6 mL/min with 0.2 M NaCl. Fifty µL of polysaccharide solution was injected at a concentration of 1 mg/mL on the column. The columns and detector compartment were maintained at 40° C. Mw-defined chondroitin sulfates (Mw: 52.2, 31.4, 20.0, 10.0, 6.6, and 1.0 kDa) were used as molecular weight standards.

Typical elution profiles of rCH (which is not fructosylated) before and after chondroitinase ABC digestion are shown in FIG. 12. Calculated weight average molecular weight of rCH was 120 kDa.

Determination of chondroitinase digestibility of K4P and DFK4P was performed as follows. K4P and DFK4P were dissolved in 50 mM THB (Tris-HCl with 50 mM sodium acetate pH 8.0), to give a final concentration of 1 mg/mL and divided into equal parts. A part of the solution was directly analyzed on the SEC-HPLC as described above. Another part was analyzed on the same system followed by processing with chondroitinase ABC (final concentration; 2 units/mL) at 37° C. for 3 hours. Results are shown in FIG. 13. The molecular weight values of K4P and DFK4P prepared from the culture of *E. coli* K4 U1-41 were 33 kDa and 28 kDa, respectively. DFK4P was completely digested into the disaccharide, Δdi-0S, by chondroitinase treatment whereas K4P was partially digested with the enzyme (FIG. 13). These results indicated that K4P was converted to the defructosylated form without affecting the chondroitin backbone structure of K4P by the defructosylation process described above. Consequently, the amount of K4P in samples can also be determined by quantifying the disaccharide enzymatically produced from the polysaccharide using the chondroitinase/HPLC method when samples were processed in the defructosylation process before the enzyme digestion.

Example 15

This Example Illustrates Sulfation of Chondroitin

Chondroitin prepared in Example 14 was subjected to partial depolymerization to obtain a chondroitin of molecular weight app. 30 kDa. 30 mg of this chondroitin was solubilized into 0.6 mL of dry formamide (FA) with stirring at 60° C. When the solution became completely homogeneous, solid sulfur trioxide-TEA complex (5 eq. of chondroitin disaccharide unit) was added and the stirring was continued for 120 min. The sulfation reaction was stopped by addition of 3× vol. of 1 M sodium acetate solution and was allowed to stand for another 30 min at room temperature. The solution was dialyzed against distilled water for 3 days, neutralized by NaOH, and lyophilized to a white powder (32 mg, 107%). Further analysis of the recombinant chondroitin sulfate demonstrated a molecular weight of 29 kDa, 5.2% of sulfur.

In another experiment, above-mentioned chondroitin (50 mg) was solubilized into 1.0 mL of dry formamide (FA) at an ambient temperature. When the solution became clear, chlorosulfonic acid (5 eq. of CH disaccharide unit) was slowly added and maintained with continuous stirring for 20 min. The sulfation reaction was stopped by addition of 3× vol. of 1 M sodium acetate solution and was allowed to stand for another 10 min. at room temperature. The solution was dialyzed against distilled water for 3 days, neutralized by NaOH, and lyophilized to give a white powder (47 mg, 94%). The analysis of the recombinant chondroitin sulfate showed a Mw of 33 kDa, 5.2% of sulfur.

Example 16

This Example Illustrates the Chondroitin Biosynthetic Region 2 Gene Set (kfoABCFG) is Sufficient for Maximal Enhancement of Chondroitin Production in E. coli Strain MSC562

A set of plasmids containing combinations of the regions 1, 2, and 3 (R1, R2, and R3) gene sets was prepared from pBR1052 (FIG. 8K) and pDD67 (FIG. 8J). As described above, sets of genes were deleted by digestion of a starting plasmid with particular restriction enzymes; generation of blunt ends, for example, with T4 polymerase; and ligation of the resulting vector fragments. E. coli strain MSC188 (Example 3) was transformed with the ligation reactions, and selected antibiotic resistant transformants were evaluated for the desired features. Due to the fact that pBR1052 contains a second Pm promoter preceding the region 1 gene set, some of the plasmids described here also contain a second Pm promoter. All of these described plasmids contain xylS. In Table 11 below, R1=kpsFEDUCS, R2=kfoABCFG, and R3=kpsMT. Note that a "Pm:R2" plasmid was previously constructed (pCX039; Example 4). DNA maps for plasmids pCX096 (SEQ ID NO:149), pCX097, pCX100, pCX101 (SEQ ID NO:150), and pCX102 are shown in FIGS. 14A, 14B, 14C, 14D, and 14E, respectively. Plasmids pCX097 and pCX101 were used as starting plasmids for pCX100 and pCX102, respectively.

TABLE 11

| retained gene sets | starting plasmid | enzymes used | plasmid name | kfo gene structure |
|---|---|---|---|---|
| R1, R2 | pBR1052 | MluI + SbfI | pCX096 | Pm: R2/Pm: R1 |
| R1, R3 | pBR1052 | AvrII + NheI | pCX097 | Pm: R3/Pm: R1 |
| R1 | pCX097 | PacI + SbfI | pCX100 | Pm: R1 |
| R2, R3 | pDD67 | PacI + PmeI | pCX101 | Pm: R3, R2 |
| R3 | pCX101 | AvrII + NheI | pCX102 | Pm: R3 |

Each of the final plasmids was transformed into host strain MSC562 resulting in the strains given in Table 12 below. These strains and pre-existing control strains were grown in shake flasks with 2×M9/tet5 medium, induced with 1 mM meta-toluic acid at OD600 values of approximately 0.1-0.12, and evaluated for growth (OD600) and rCH production after 72 hours.

TABLE 12

| strain | plasmid | properties | OD600 72 hr | rCH (µg/mL) 72 hr |
|---|---|---|---|---|
| MSC563 | pDD63 | (empty) | 5.25 | 107 |
| MSC564 | pCX039 | Pm: R2 | 3.52 | 678 |
| MSC681 | pDD66 | Pm: R3, R2, R1 | 7.46 | 522 |
| MSC682 | pDD67 | Pm: R1, R3, R2 | 8.40 | 208 |
| MSC683 | pCX096 | Pm: R2/Pm: R1 | 6.96 | 729 |
| MSC684 | pCX097 | Pm: R3/Pm: R1 | 2.32 | 172 |
| MSC687 | pCX100 | Pm: R1 | 5.83 | 292 |
| MSC688 | pCX101 | Pm: R3, R2 | 7.80 | 277 |
| MSC689 | pCX102 | Pm: R3 | 5.24 | 121 |
| MSC690 | pBR1052 | Pm: R3, R2, Pm: R1 | 6.29 | 140 |

The greatest productivities were seen in strains with plasmids carrying only region 2 (MSC564) or the combination of regions 2 and 1 (MSC683). The combination of regions 2 and 3 (MSC688) resulted in lower productivity. In fact, the presence of plasmid-borne region 3 appeared inhibitory in other relevant strain comparisons as well (for example, MSC683 vs. MSC690). These findings support the approach of increasing rCH productivity by increasing just the region 2 copy number in strain MSC562.

Example 17

This Example Illustrates the Positive Copy Number Effect of Chondroitin Biosynthetic Gene Region 2 Requires all Five of the kfoABCDG Genes Plasmid pCX039 (FIG. 8Q; containing the region 2 genes kfoABCFG) drove a large (8 to 10-fold) increase in rCH production when present in host E. coli strain MSC562 (as compared to MSC562 containing the empty vector pDD63). Using methods described above (see Example 4) for the deletion of genes from pDD66 and pDD67, two sets of plasmids were derived from pCX039 to demonstrate the roles of individual region 2 genes on stimulation of rCH production by pCX039.

One set of five plasmids was designed to evaluate the effects of the removal of one of the region 2 genes. In an E. coli host such as MSC562, one copy of these genes would still be present (integrated into the chromosome). This set of plasmids included pCX039 derivatives from which each of the kfoABCFG has been individually deleted. Table 13 below lists the restriction enzymes used to delete the kfo genes and the names of the resulting plasmids. Example 4 above describes the derivation of pCX044 in detail. All plasmids contain xylS.

TABLE 13

| deleted gene | enzyme used | plasmid name | kfo genes |
|---|---|---|---|
| kfoA | RsrII | pCX082 (SEQ ID NO: 152) | kfoBCFG |
| kfoB | BstBI | pCX044 (SEQ ID NO: 43) | kfoACFG |
| kfoC | SpeI | pCX075 (SEQ ID NO: 153) | kfoABFG |
| kfoF | AflII | pCX081 (SEQ ID NO: 151) | kfoABCG |
| kfoG | NheI | pCX092 (SEQ ID NO: 154) | kfoABCF |

These plasmids were transformed into host stain MSC562 (chromosomal copies of regions 1, 2 and 3 plus xylS) to generate the strains shown in Table 14 below. Cultures were grown in 2×M9 medium (with 10 g/L glycerol and 2 µg/mL Tet) at 30°, induced with 1 mM mTA at OD600 values of approx. 0.1, and assayed for rCH production after 72 hours of growth.

TABLE 14

| Strain | Plasmid | Properties | OD600 72 hr | rCH (µg/mL) 72 hr |
|---|---|---|---|---|
| MSC563 | pDD63 | (empty) | 6.61 | 92 |
| MSC564 | pCX039 | kfoABCFG | 3.24 | 917 |
| MSC566 | pCX081 | kfoABCG (ΔkfoF) | 6.88 | 455 |
| MSC567 | pCX082 | kfoBCFG (ΔkfoA) | 7.05 | 621 |
| MSC640 | pCX044 | kfoACFG (ΔkfoB) | 5.81 | 520 |
| MSC641 | pCX075 | kfoABFG (ΔkfoC) | 6.87 | 712 |
| MSC643 | pCX092 | kfoABCF (ΔkfoG) | 3.91 | 775 |

These results indicate that all five region 2 genes (kfoAB-CFG) are required to achieve maximal productivity under these conditions. The results for MSC563 also indicate that the expression of the kfoABCFG genes from the chromosomal insertion is sufficient to support significant rCH production in the absence of plasmid-borne gene copies.

A second set of pCX039 derivatives was designed to evaluate the effects of the presence of individual plasmid-borne region 2 genes on enhancement of rCH titers in host strain MSC562. As a means of keeping expression levels comparable among the resulting plasmids, the promoter-proximal kfoA gene was retained in all constructs. While this design strategy does not allow for evaluation of plasmid-encoded kfoB, C, F, or G genes in complete isolation, the retention of the kfoA gene and the resulting fixed relationship between the Pm promoter and the first reading frame in all of these plasmids are expected to make expression levels from the Pm promoter comparable. Using the same strategies as described above, the following derivations (Table 15) were carried out. All plasmids contain xylS.

TABLE 15

| Retained gene(s) | Starting plasmid | Enzyme(s) used | Plasmid name | kfo genes |
|---|---|---|---|---|
| | pCX044 (kfoACFG) | SpeI | pCX050 | kfoAFG |
| kfoF (+ kfoA) | pCX050 | NheI | pCX070 | kfoAF |
| kfoA | pCX070 | AflII | pCX095 | kfoA |
| kfoB (+ kfoA) | pCX039 (kfoABCFG) | NheI + SpeI | pCX093 | kfoAB |
| kfoC (+ kfoA) | pCX044 | AflII | pBR1077 | kfoACG |
| | pBR1077 | NheI | pBR1082 | kfoAC |
| kfoG (+ kfoA) | pCX050 | AflII | pCX094 | kfoAG |

Each of the final set of plasmids was transformed into host strain MSC562 resulting in the strains given in Table 16 below. These strains and MSC563 and MSC564 controls were grown in shake flasks with 2×M9/tet2 medium, induced with 1 mM meta-toluic acid at OD600 values of 0.08-0.18, and evaluated for growth (OD600) and rCH production after 68 hours.

TABLE 16

| strain | plasmid | properties | OD600 68 hr | rCH (µg/mL) 68 hr |
|---|---|---|---|---|
| MSC563 | pDD63 | (empty) | 4.82 | 103 |
| MSC564 | pCX039 | kfoABCFG | 7.91 | 861 |
| MSC656 | pCX095 | kfoA | 5.06 | 146 |
| MSC657 | pCX093 | kfoAB | 5.18 | 236 |
| MSC658 | pBR1082 | kfoAC | 5.22 | 341 |
| MSC659 | pCX070 | kfoAF | 4.99 | 198 |
| MSC660 | pCX094 | kfoAG | 5.53 | 130 |

These data demonstrate that none of the K4 region 2 genes (kfoABCFG) individually are sufficient to maximally stimulate rCH production in the MSC562 host strain. Taken together with the findings described above (e.g., Example 16), it is clear that including all five genes of the region 2 gene set results in maximal enhancement of rCH production.

Example 18

This Example Illustrates Constructs for Increased Chromosomal Copy Number of Chondroitin Biosynthetic Gene Region 2 for Greater Chondroitin Production Example 12 demonstrates that the addition of a single chromosomal copy of the region 2 gene set (kfoABCFG) in an *E. coli* host already containing single chromosomal copies of regions 1, 2, and 3 leads to a significant 20-30% increase in rCH production. Example 11 demonstrates that a similar host containing a multi-copy plasmid carrying the region 2 gene set leads to a 2-300% increase in rCH production. With the goal of generating high-producing, plasmid-free strains, this example describes the construction and use of plasmids designed to increase the chromosomal complement of region 2 copies (driven by the Pm promoter) by inserting them into various non-essential chromosomal genes chosen specifically to facilitate identification of such insertions. It is noted that in using the homology-driven "pop-in/pop-out" methodology (see Examples 4 and 12) to successively insert copies of region 2 gene sets into different loci in the host *E. coli* chromosome, there is increasing competition for undesired targeting (homology-driven recombination) into pre-existing region 2 inserts instead of the desired locus. Therefore, having a means of initially identifying strains containing inserts at the desired locus by simple colony screening instead of by more laborious and time-consuming PCR becomes increasingly beneficial as the number of region 2 copies in the host strain rises.

In this example, three *E. coli* target loci are described. These are the genes lacZ, mtlA, and the fruBKA operon (referred to as "fruA" for simplicity in some cases) that are necessary for growth on the sugars lactose, mannitol, and fructose, respectively, but not for growth on other carbon sources such as glucose or glycerin. Colonies of strains disrupted for these genes can be visually identified on indicator agars such as MacConkey's (Miller, J H, *Experiments in Molecular Genetics*, 1972) by colony color differences: pink/red for strains able to utilize the incorporated sugar and white/light pink for strains with gene disruptions (e.g., insertions). Alternatively, LB/Xgal/IPTG agar medium (ibid.) can be used to detect defects in lactose metabolism: blue colonies for strains able to utilize lactose and white/buff colonies for strains unable to utilize lactose (such as strains with insertions into the lacZ gene). Methods such as these, which use color differences, allow the visual identification of strains likely to have insertions into the desired locus among a population of colonies with insertions elsewhere. Those skilled in the art will recognize that other target loci exist in E. coli that will allow the screening or selection of desired insert events; non-limiting examples include pepP, pepQ, feuA(cirA), malB (lamB), nupA(tsx).

To facilitate the use of plasmid pMAK705 for insertion of region 2 ("R2") into the fruBKA, lacZ, and mtlA genes, a derivative of pMAK705 containing a multi-cloning site was first developed. Primers DHD266c and DHD267c contain one-strand halves of a multiple restriction (cloning) site (NotI, XhoI, AscI, SalI, BglII, HindIII) and are complementary except for 2-base single strand ends that (when annealed) are compatible with overhangs generated by digestion of pMAK705 with AseI and ClaI. Neither AseI nor ClaI restriction sites are regenerated upon ligation of these compatible ends.

DHD266c
(SEQ ID NO: 155)
TAGCGGCCGCATACTCGAGCATGGCGCGCCTAACGTCGACTAAGATCTC

TAAGCTT

DHD267c
(SEQ ID NO: 156)
CGAAGCTTAGAGATCTTAGTCGACGTTAGGCGCGCCATGCTCGAGTATG

CGGCCGC

Figure 14A:
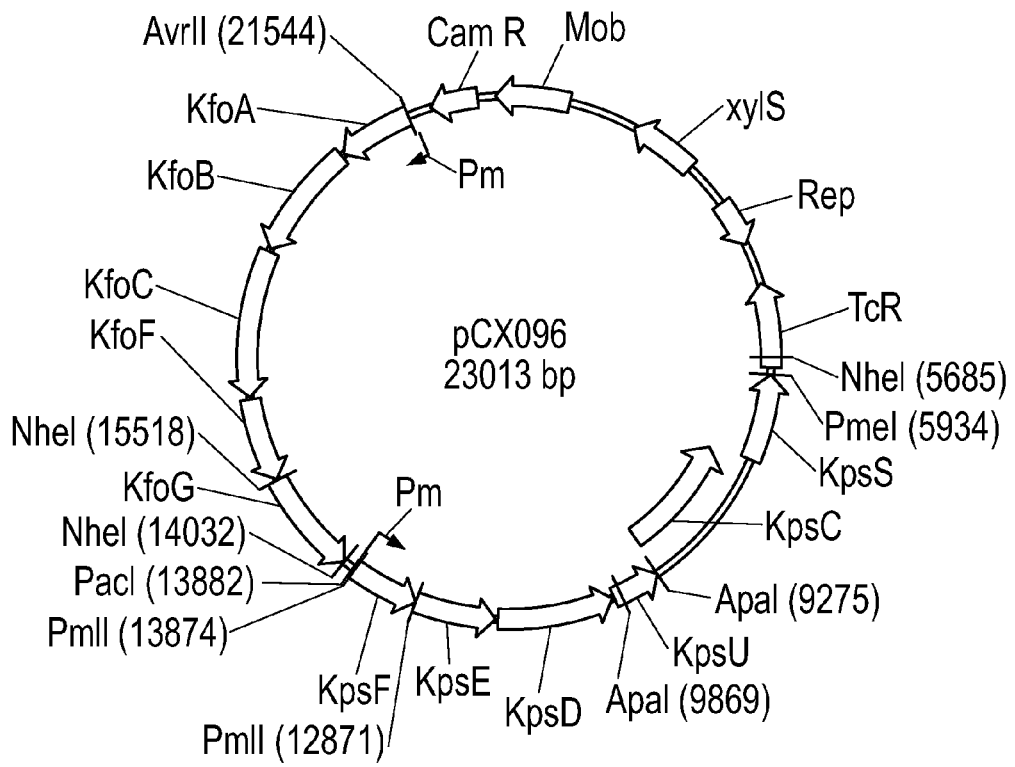
FIGS. 14A-14X show the DNA maps for plasmid constructs pCX096, pCX097, pCX100, pCX101, pCS102, pCX075, pCX082, pCX081, pCX092, pBR1077, pBR1082, pCX050, pCX070, pCX093, pCX094, pCX095, pMAK705 pl, pBR1103, pBR1093lacZ, pBR100-lac, pBR1094mt1, pBR1101-mt1, pBR1095fru, and pBR1102-fru of the present invention.
Figure 14B:
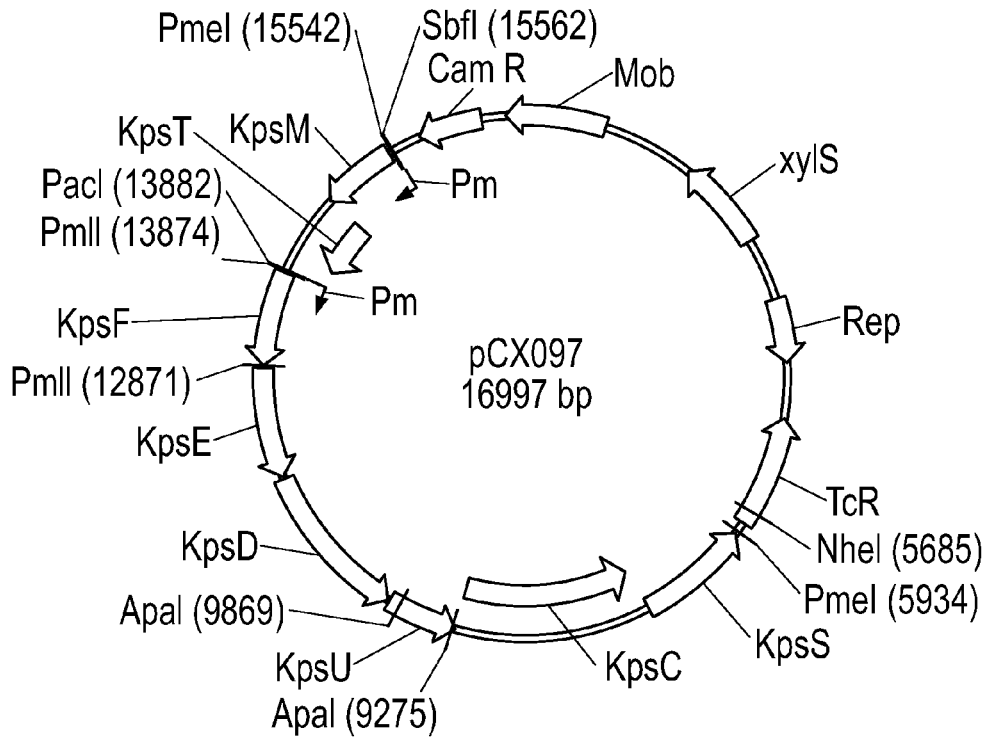
Figure 14C:
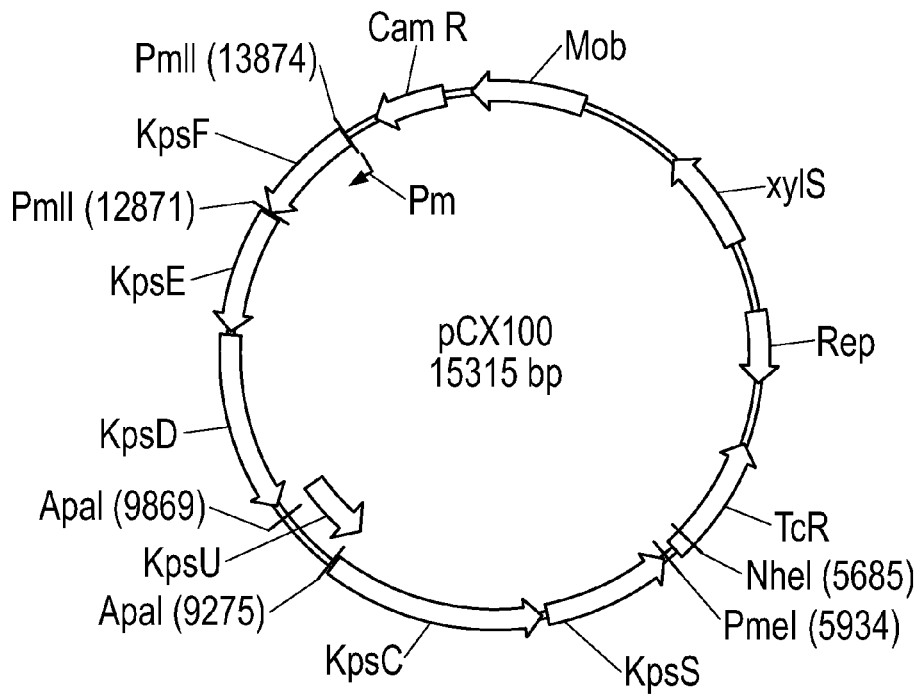
Figure 14D:
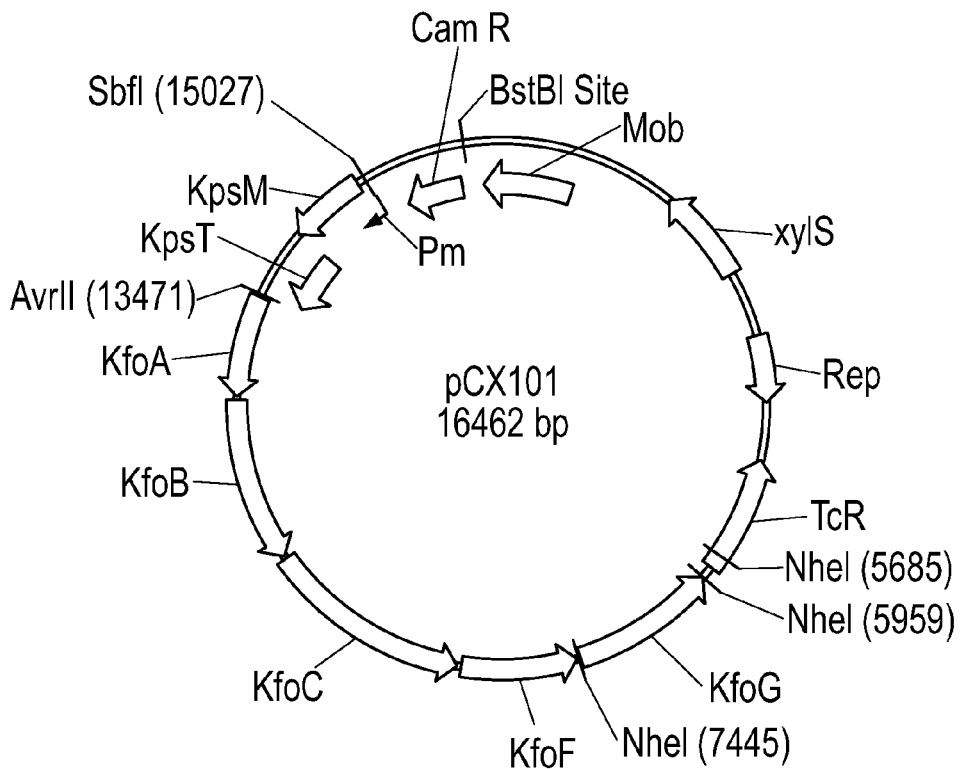
Figure 14E:
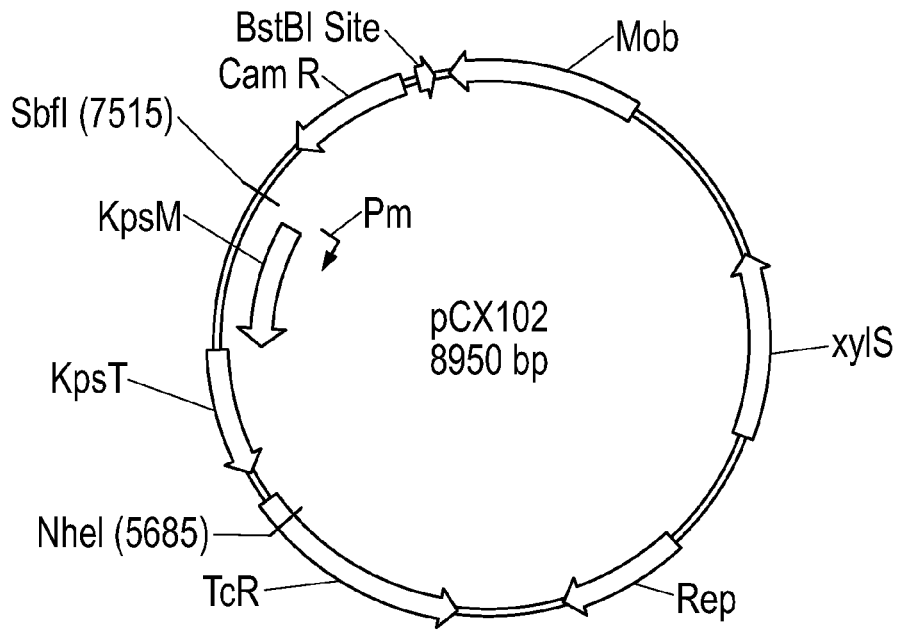
Figure 14F:
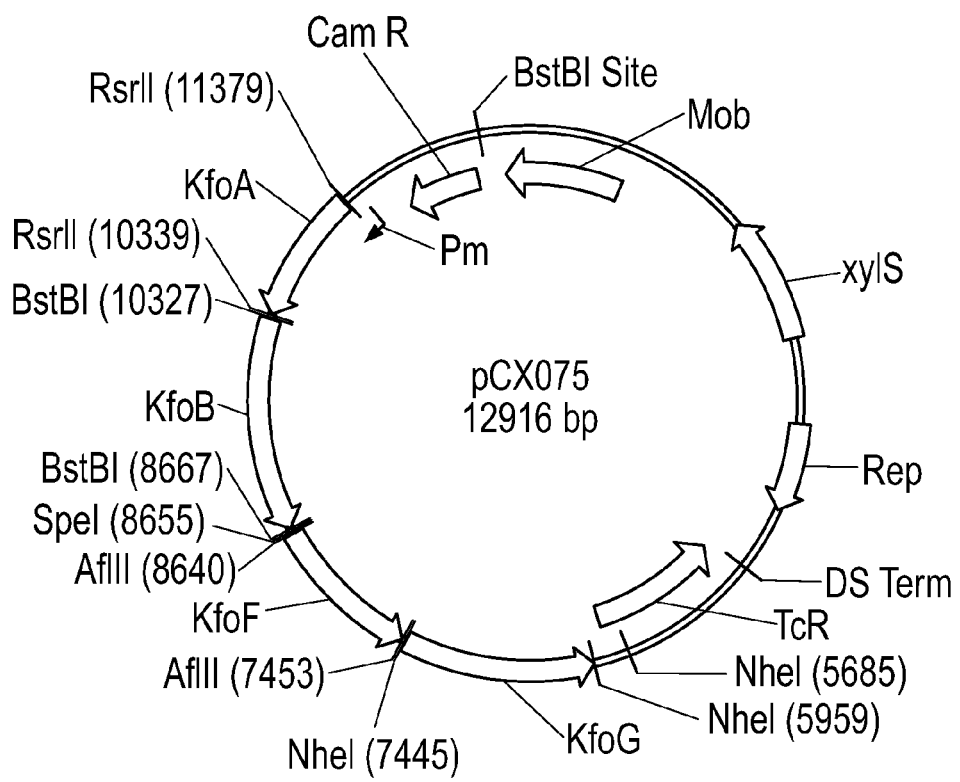
Figure 14G:
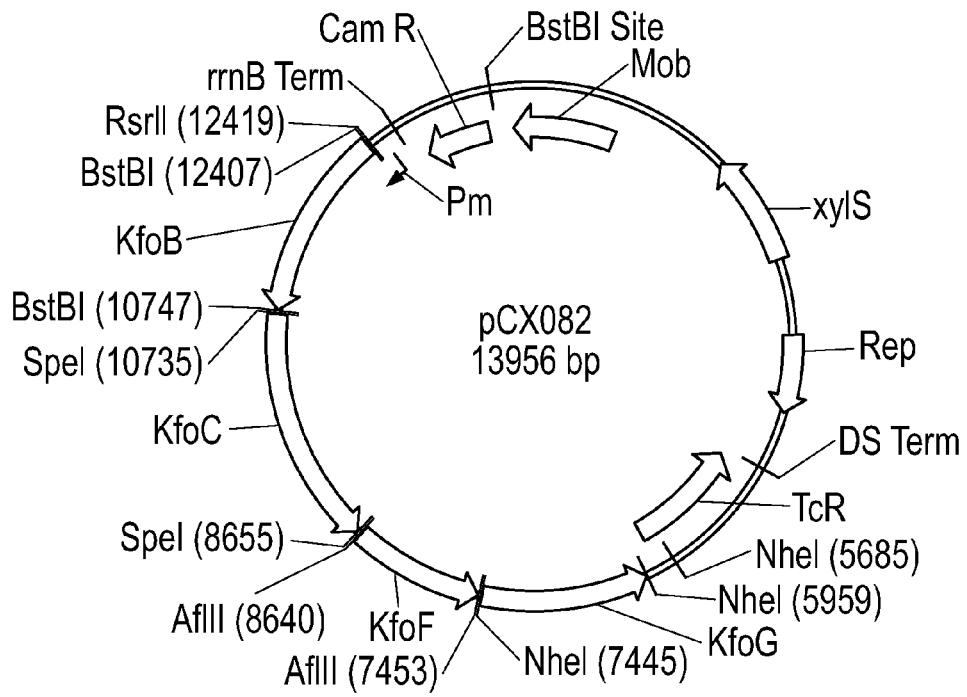
Figure 14H:
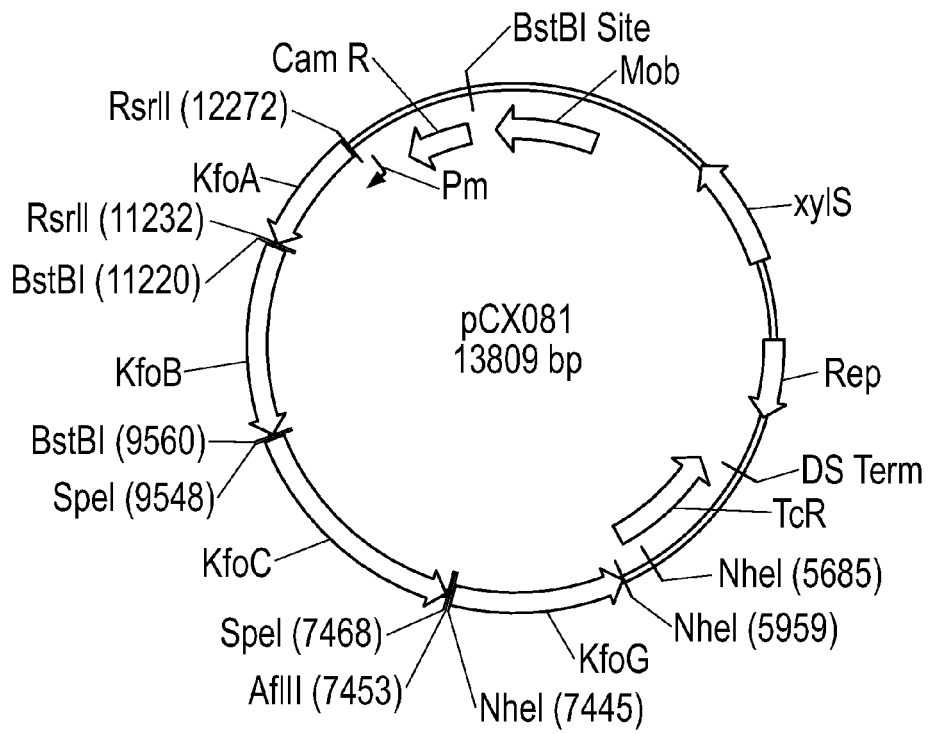
Figure 14I:
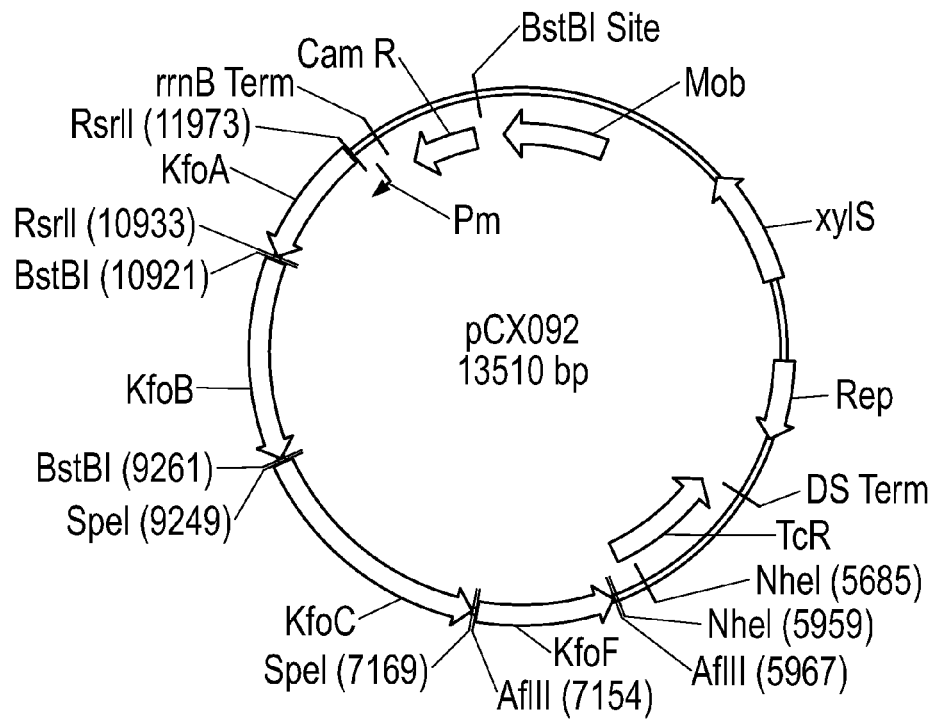
Figure 14J:
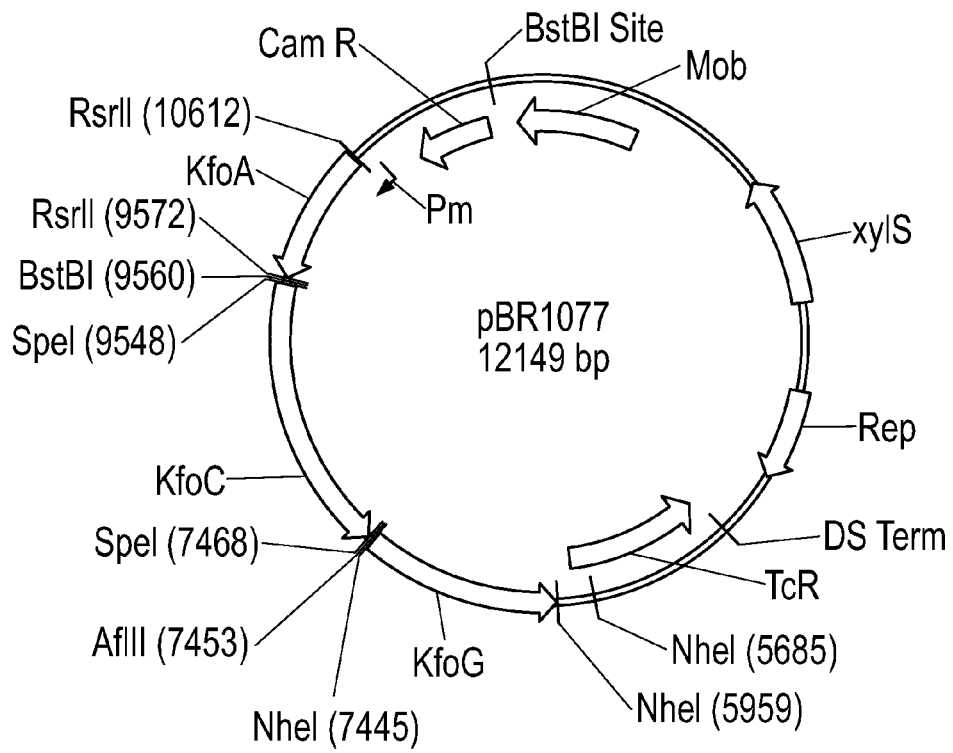
Figure 14K:
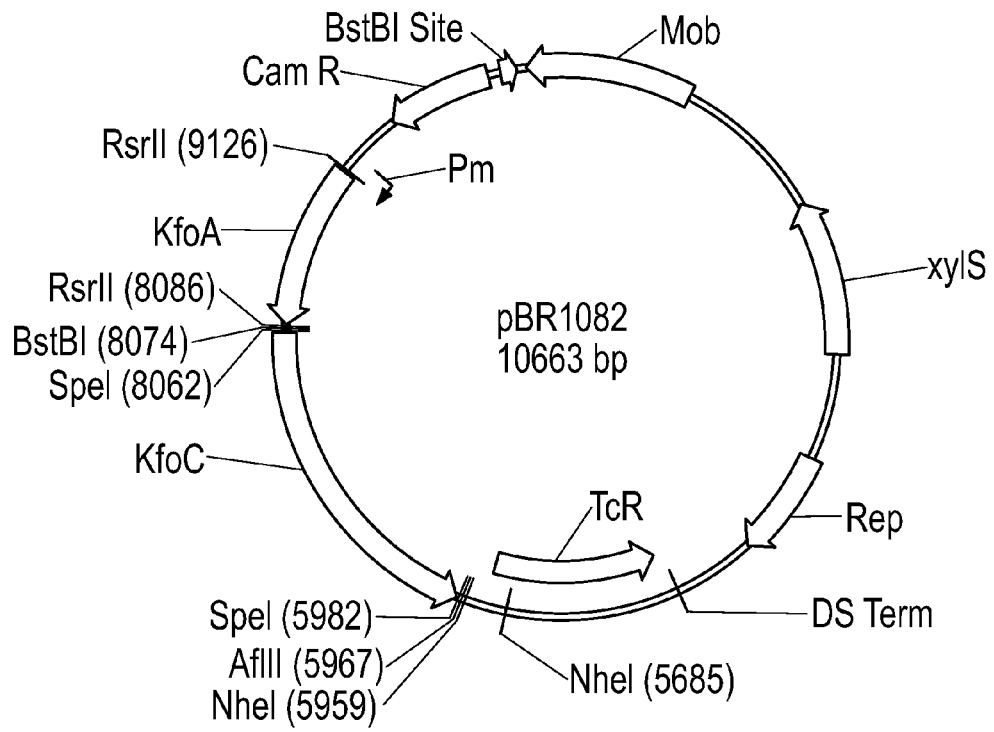
Figure 14L:
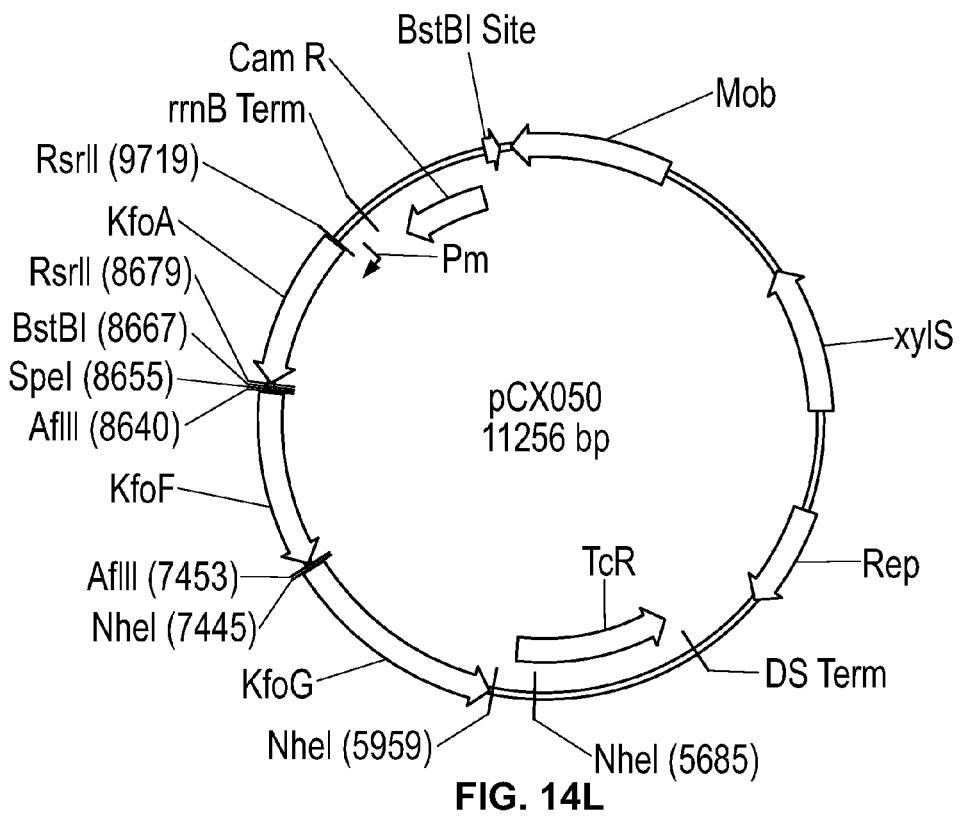
Figure 14M:
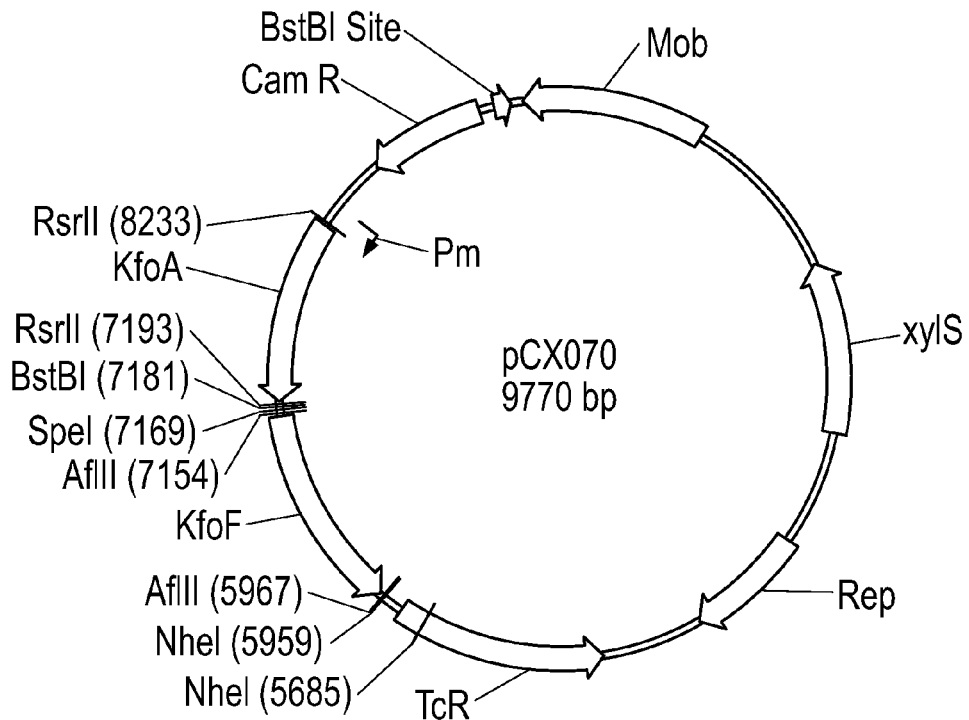
Figure 14N:
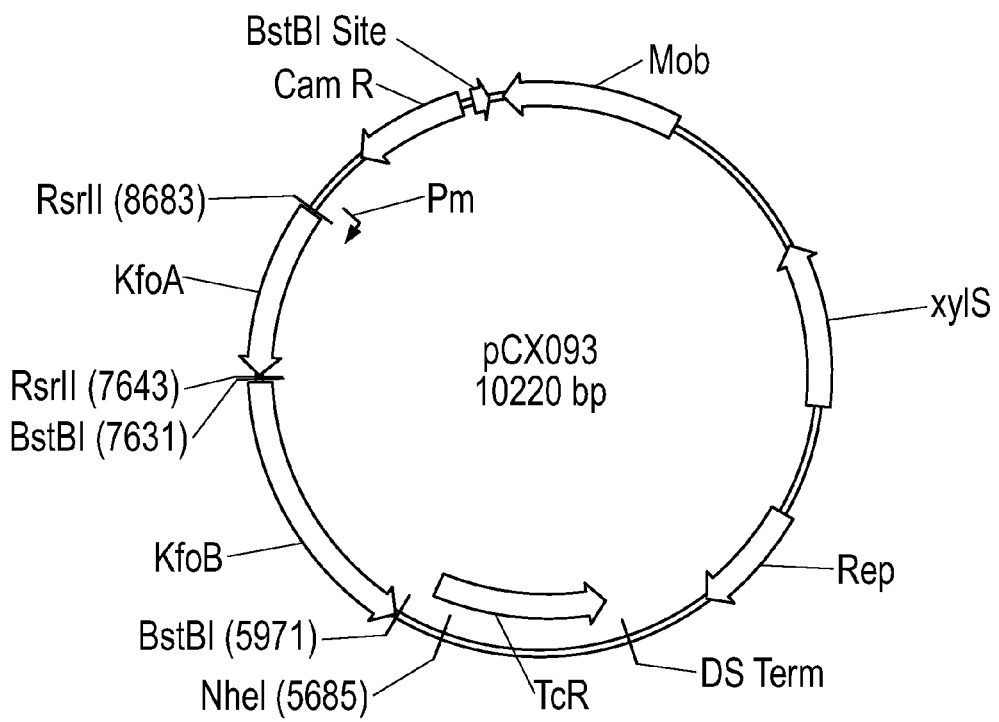
Figure 14O:
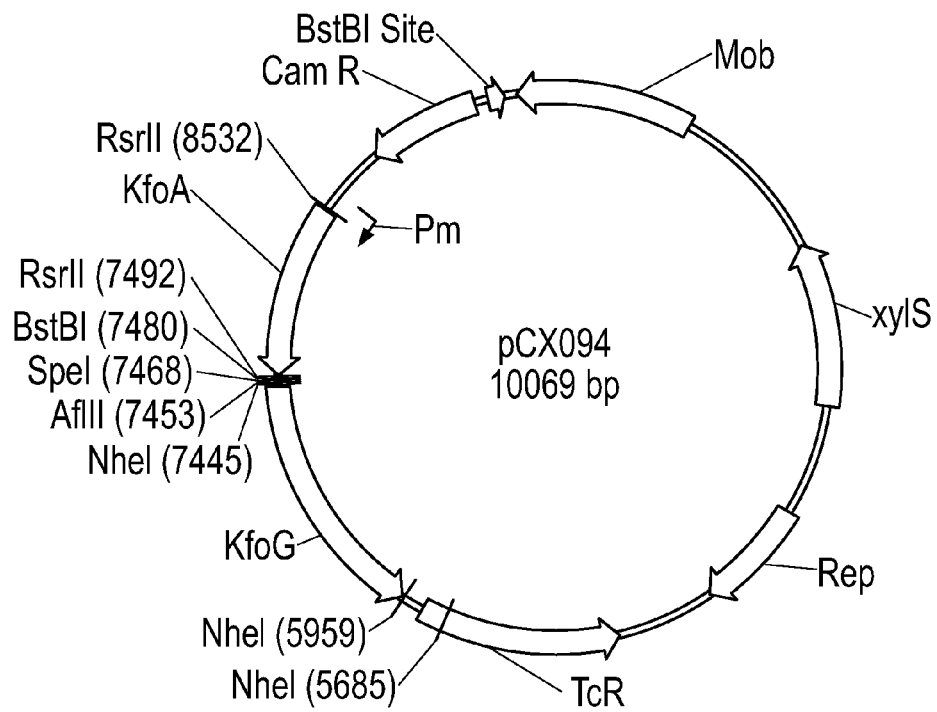
Figure 14P:
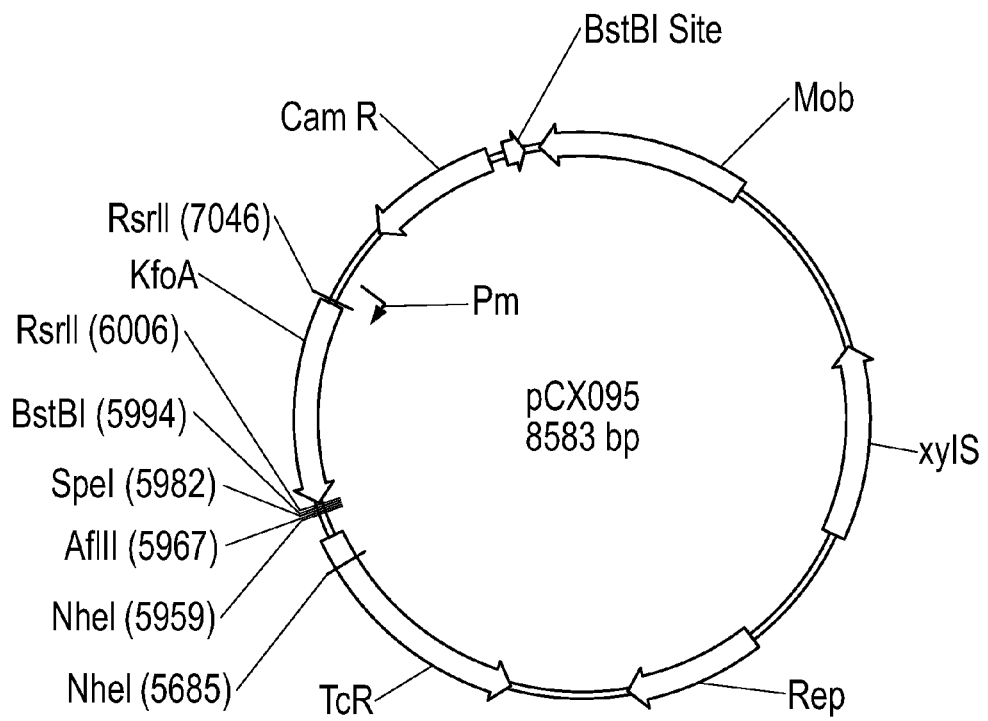
Figure 14Q:
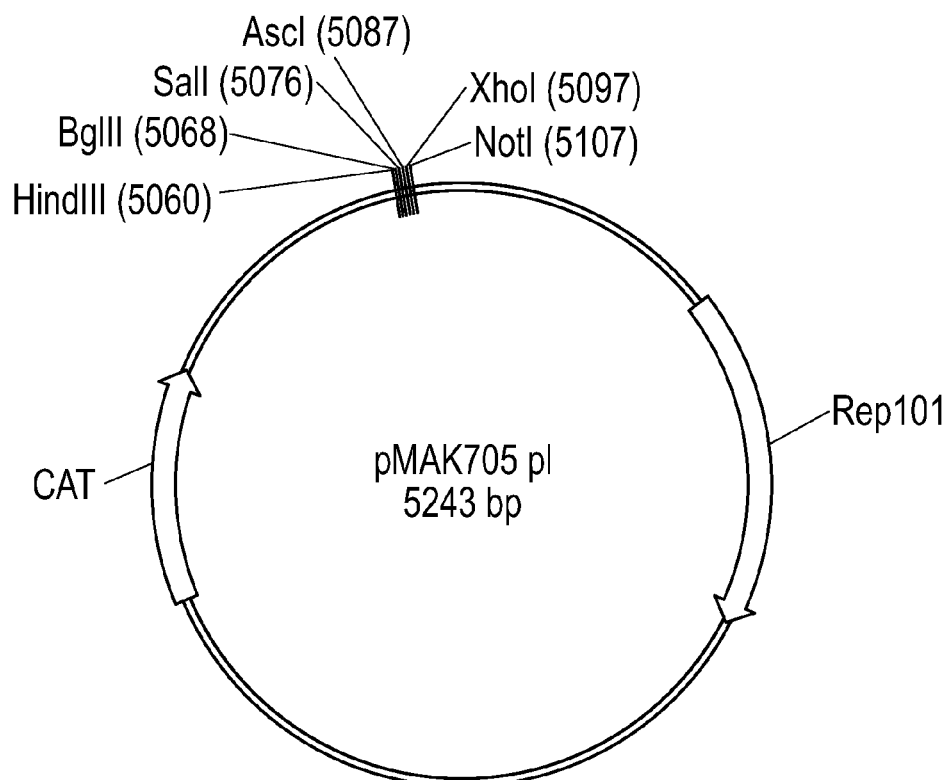

Plasmid pMAK705 was digested with AseI and ClaI, and the vector fragment was gel-purified. Phosphorylated oligonucleotides DHD266c and DHD267c were annealed (200 nM each oligonucleotide, 90° C. for 5 min, slow cooling to 50° C. for 30 min), and then ligated to the pMAK705 vector fragment. Ligation reactions were transformed into E. coli NEB10β with selection for chloramphenicol resistance. Plasmids in isolated transformants were screened by PCR and then for the presence of MCS restriction enzyme sites. Sequencing of the MCS region identified a plasmid with the desired structure. This plasmid was named pMAK705 μl (SEQ ID NO:157; FIG. 14Q).

The construction of three vectors for insertion of R2 into the fruBKA, lacZ, and mtlA loci all took the same two-step approach. In a first step, the upstream and downstream regions of homology were generated for each target locus using PCR primers that allow annealing between the "inside" ends of the PCR products. This region of homology encompasses multiple restriction sites that were later used for addition of R2. In a second step, the upstream and downstream PCR products for each locus are mixed in a PCR reaction with the two "outside" primers used originally to synthesize the individual template members. Due to the end homologies designed into the upstream and downstream PCR products (now templates in step 2), the results of the step 2 reactions were DNA fragments comprising the appropriate orientations of the upstream and downstream regions flanking multi-cloning sites. The PCR products from step 2 were digested with enzymes whose recognition sequences were designed into the "outside" primers: NotI for upstream ends and HindIII for the downstream ends. These fragments were then individually cloned into pMAK705 pl (SEQ ID NO:157) digested with NotI and HindIII. The three resulting plasmids contained approximately 900-1000 bp of properly oriented upstream (UP) and downstream (DN) regions flanking multi-cloning sites (MCS) to be used to accept R2 copies. For pBR1093, the MCS replaced about 20 bp of lacZ coding region. For pBR1094, the MCS was inserted into the mtlA coding region. For pBR1095, the MCS replaced the 3-prime end of fruB, all of fruK, and the 5-prime end of fruA. The primers used to prepare these intermediate constructs are listed in Table 25 below.

Figure 14R:
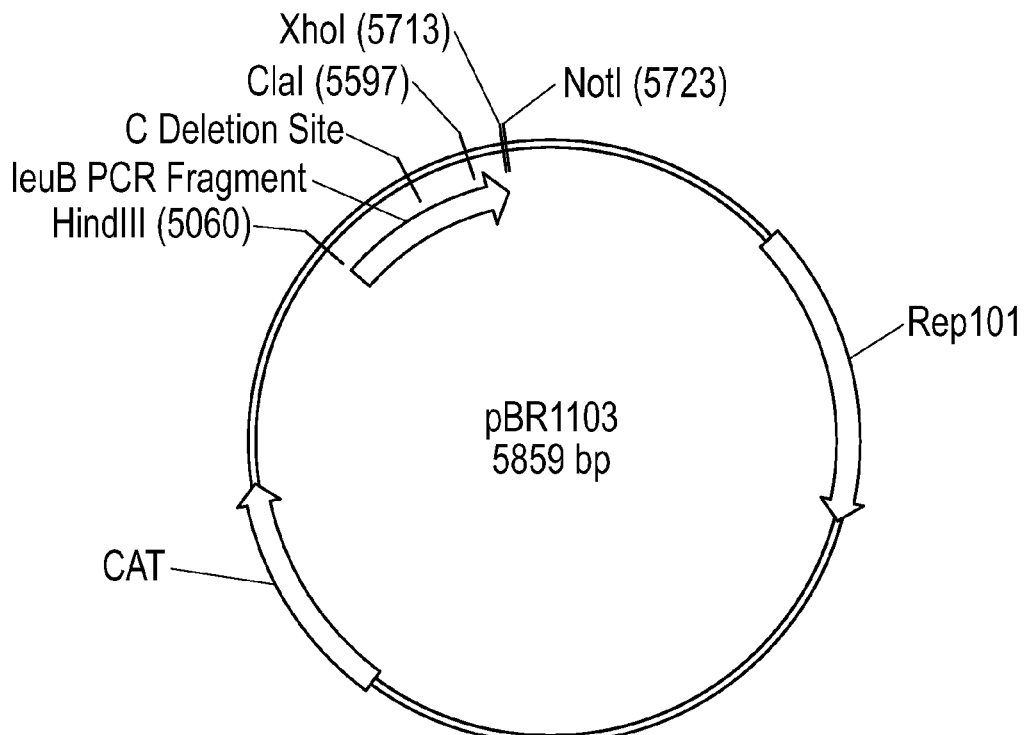
Figure 14S:
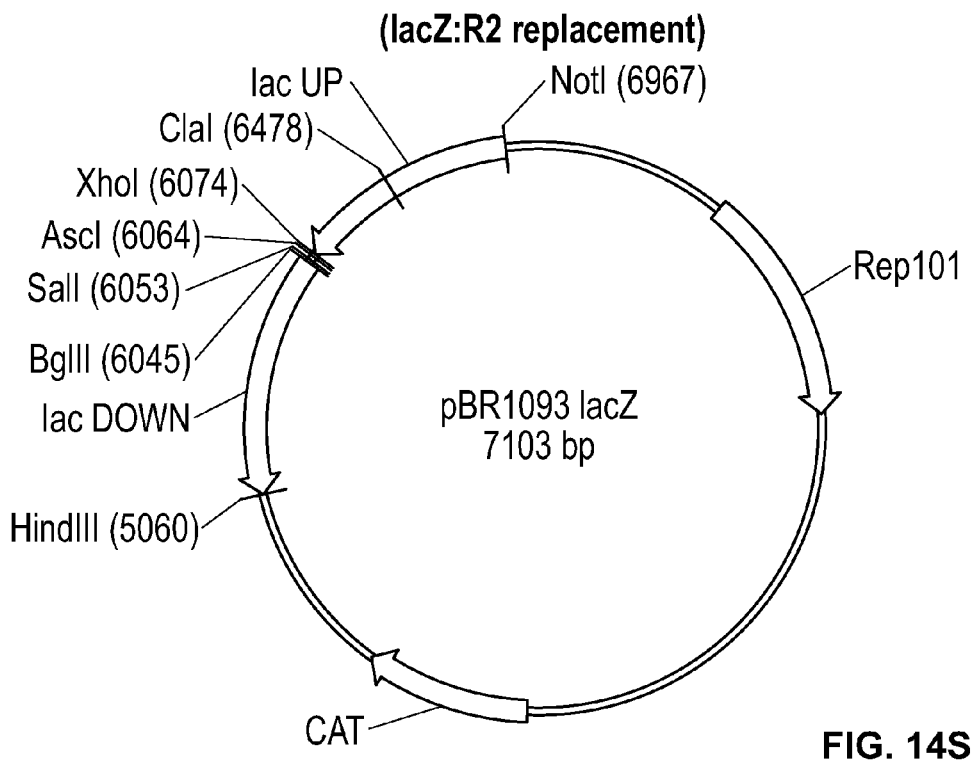
Figure 14T:
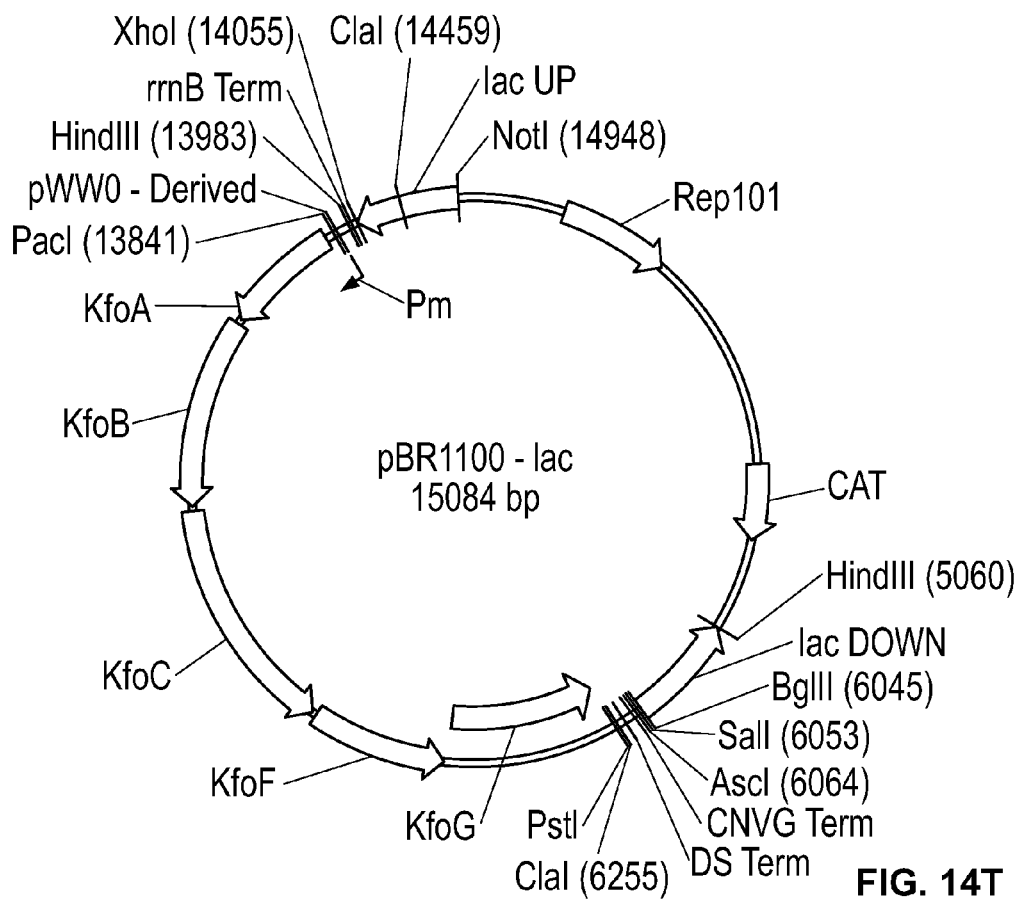
Figure 14U:
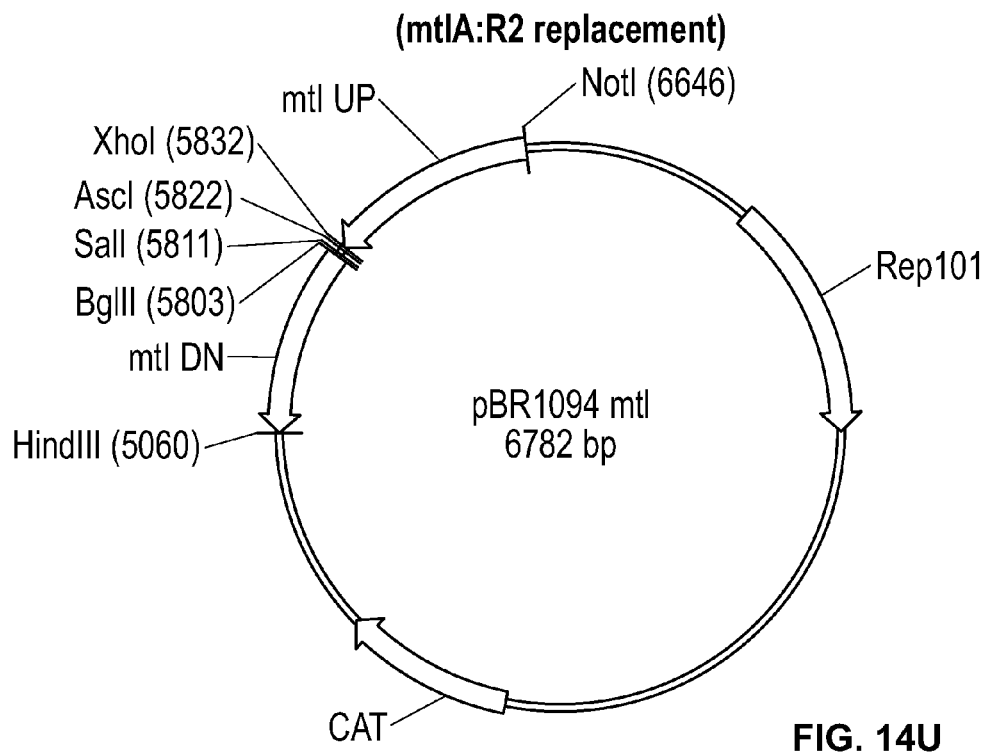
Figure 14V:
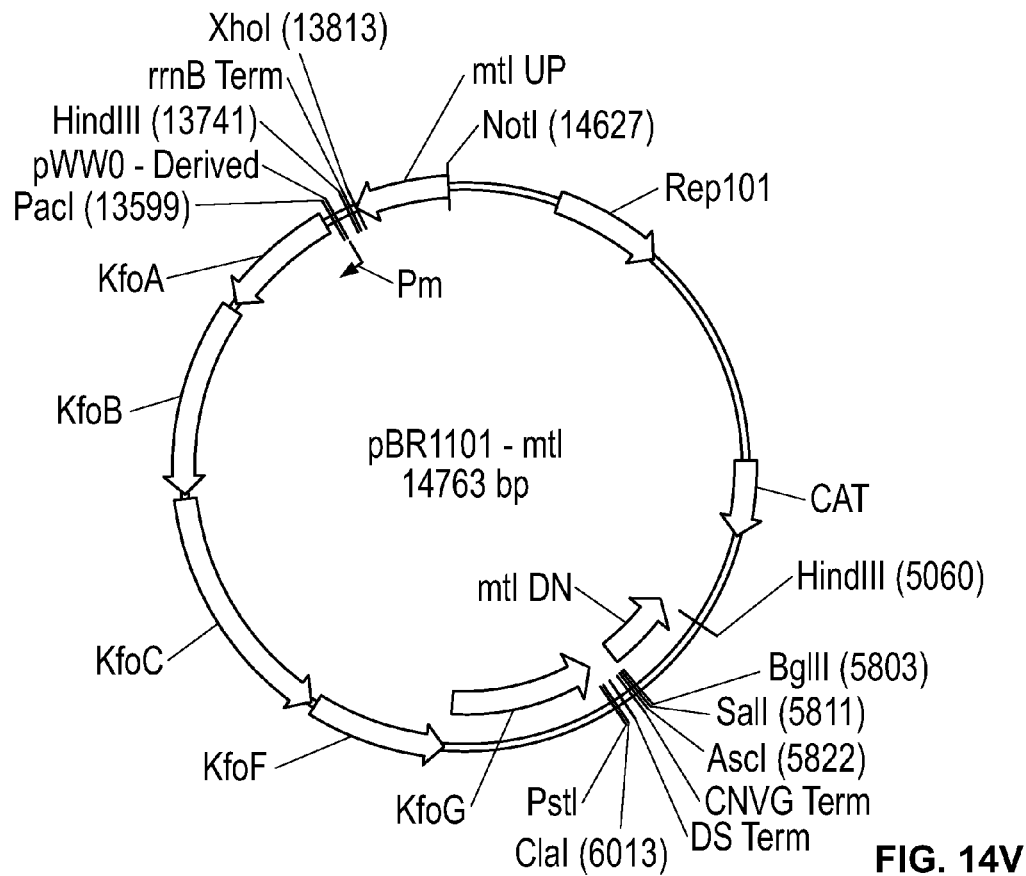
Figure 14W:
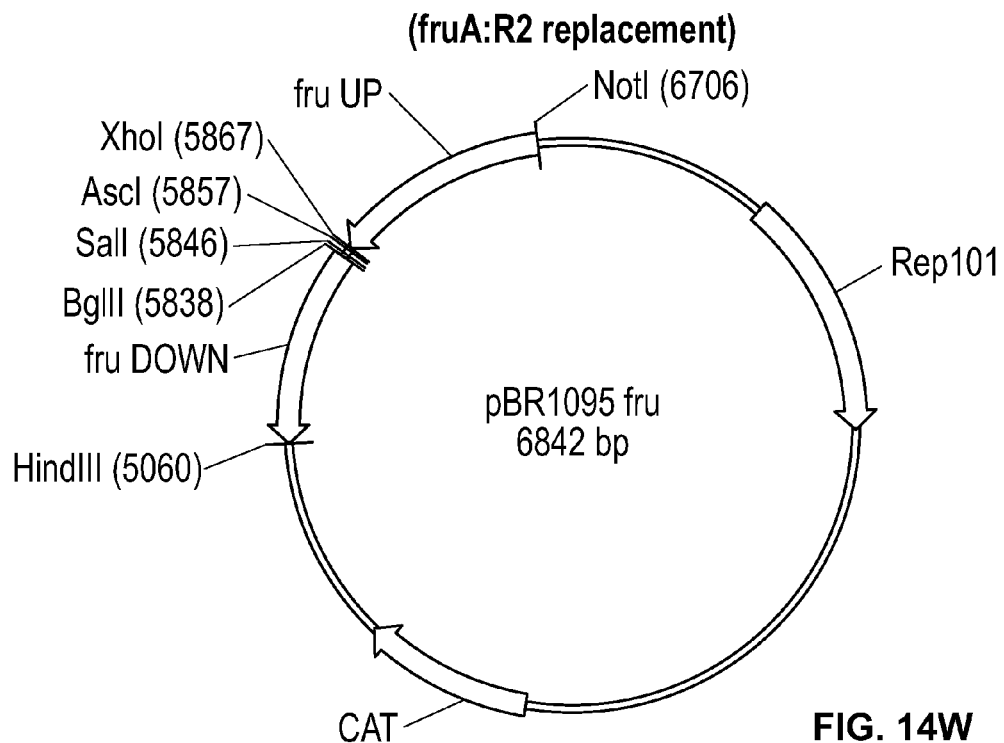

To prepare the region 2 gene set for cloning into pBR1093, pBR1094, and pBR1095, the kfoABCFG genes were excised (without the Pm promoter) from pCX074 (see Example 11) using PacI+ClaI. The purified R2 fragment was then cloned into pJ201:11352 (see FIG. 8B) digested with the same enzymes. This resulted in plasmid pBR1096 in which the kfoABCFG genes were again orientated behind the Pm promoter. Now, however, Pm:R2 could be isolated from pBR1096 as a XhoI/AscI fragment for cloning into pBR1093 (FIG. 14S), pBR1094 (FIG. 14V), and pBR1095 (FIG. 14W). Table 17 provides the designation of the final replacement pMAK705-based Pm:R2 insertion plasmids pBR1100 (for the lacA locus), pBR1101 (for the mtlA locus), and pBR1102 (for the fruBKA locus). The sequences for primers DHD280c, DHD281c, DHD283, DHD285, DHD268c, DHD269c, DHD271, DHD273, DHD274c, DHD275c, DHD277, and DHD279 are shown in SEQ ID NOs:158-169, respectively.

TABLE 17

| locus | Step 1 PCRs | | Step 2 PCR | UP/MCS/DN plasmid | final plasmid UP/Pm: R2/DN |
|---|---|---|---|---|---|
| | upstream | downstream | | | |
| fruBKA | DHD280c × DHD281c | DHD283 × DHD285 | DHD280c × DHD285 | pBR1095 | pBR1102 (SEQ ID NO: 170) |
| lacZ | DHD268c × DHD269c | DHD271 × DHD273 | DHD268c × DHD273 | pBR1093 | pBR1100 (SEQ ID NO: 171) |
| mtlA | DHD274c × DHD275c | DHD277 × DHD279 | DHD274c × DHD279 | pBR1094 | pBR1101 (SEQ ID NO: 172) |

Figure 14X:
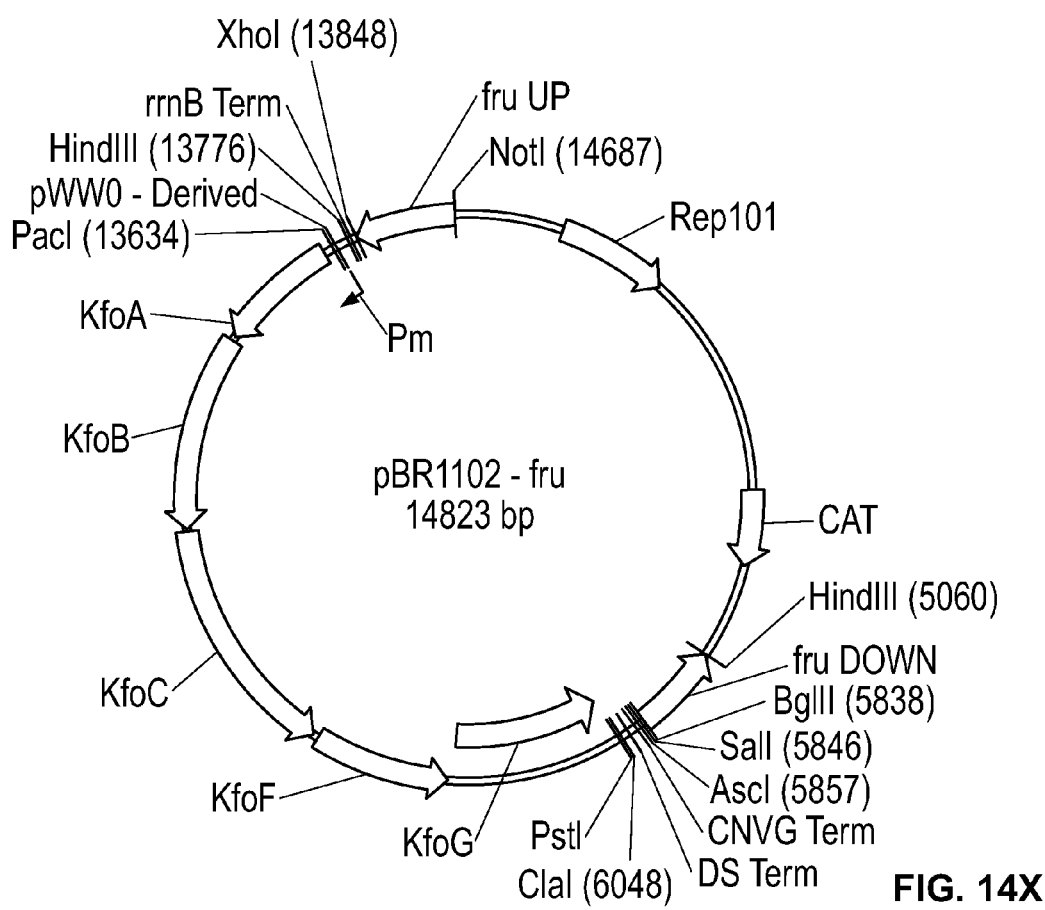
Figure 15:
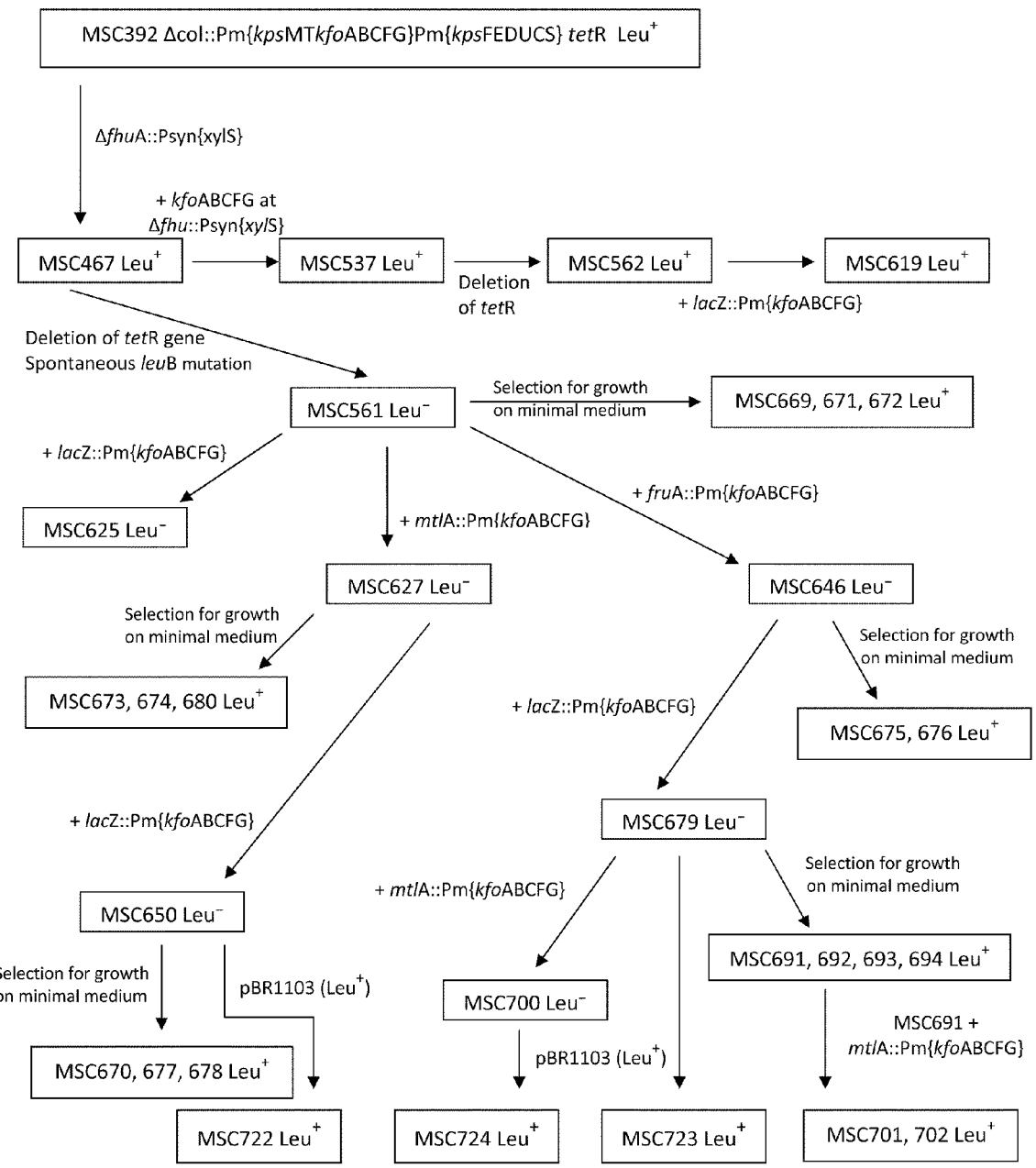
FIG. 15 shows a family tree of chondroitin-producing *E. coli* strains and the steps used for strain derivation.

The previously-described "pop-in/pop-out" methodology was used with plasmids pBR1100 (SEQ ID NO: 171; FIG. 14T), pBR1101 (SEQ ID NO:172; FIG. 14V) and pBR1102 (SEQ ID NO:170; FIG. 14X) to impart additional Pm:R2 copies to chosen E. coli strains. Strains were transformed with pBR1100, pBR1101, or pBR1102 at 30° C. with selection for chloramphenicol resistance. Transformants were then plated at 43° C. to MacConkey/fructose/Cm agar (for pBR1102 transformants), MacConkey/mannitol/Cm agar (for pBR1101 transformants), or LB/Xgal/IPTG/Cm agar (for pBR1100 transformants). Colonies that were conspicuously less colored were chosen for further analysis. Among these, strains with plasmids integrated into the target loci were identified by PCR. Strains with successfully-integrated plasmids were then grown for multiple (e.g., 20-30) generations in the absence of chloramphenicol selection. Colonies derived from these cultures were screened for chloramphenicol sensitivity (reflecting excision of the plasmids) and defects in sugar metabolism (reflecting retention of the targeted Pm:R2 insertion). Isolates with the desired phenotypes were evaluated by PCR for the correct chromosomal structures. FIG. 15 diagrams the multiple steps in strain derivation utilizing the methods described in this and other Examples. As an illustration and summary, strain MSC702 contains the following key elements: Pm[kpsMTkfoABCFG]Pm[kpsFE-DUCS] inserted at the colanic acid locus, Psyn[xylS] inserted at the fhuA locus, Pm[kfoABCFG] inserted at the fruBKA, lacZ and mtlA loci, and (presumed due to its derivation from MSC691; see Example 19) 8 base pair changes within the leuB gene.

Example 19

This Example Illustrates the Identification and Correction of Spontaneously-occurring Auxotrophy in E. coli Strains During the course of evaluating recombinant E. coli strains for rCH production in minimal growth medium, it was discovered that certain strains did not grow. It was subsequently determined that strain MSC561 grew on minimal medium only when amended with a source of leucine; i.e., this strain is a leucine auxotroph. Sequencing of the leucine biosynthetic operon leuABCD in MSC561 revealed that the strain had spontaneously acquired a single base pair deletion in the leuB gene coding region (a C/G base pair at position 383 of the coding region) during its derivation from the leucine prototroph MSC467 (see Example 10). This deletion results in a reading frame shift and pre-mature translation termination. This defect was not initially detected because genetic manipulations and early production tests were conducted in complex media. It is very unlikely that this mutation was the result of previous targeted recombination at the fhuA and colanic acid loci because they are not closely linked to leuB (fhuA and leuB are about 85 Kb apart; the colanic acid operon and leuB are about 2 Mb apart). All strains immediately or sequentially derived from MSC561 by addition of R2 copies (such as MSC627, MSC650, MSC646, MSC679, and MSC700; see FIG. 15) were also leucine auxotrophs and contained the identical deletion in the leuB sequence. Strains in a separate lineage of MSC467 (MSC537, MSC562, and MSC619) are leucine prototrophs. (see FIG. 15).

Two approaches were used to convert selected leucine auxotrophs to prototrophs (therefore allowing growth in minimal media without added leucine). In one approach, large numbers (about $10^6$-$10^7$) of cells of an auxotrophic strain were applied to a minimal medium agar plate followed by incubation at 30° C. for 3-7 days. Typically, several colonies develop under these conditions. Strains isolated from these colonies ("spontaneous revertants") reproducibly grow on solid and liquid minimal media without leucine. Sequence analysis of the leuB gene of selected revertants revealed (in most cases) small insertions or deletions near the site of the original single base pair deletion that result in the restoration of the correct leuB reading frame. Table 18 below provides the locations of the nucleotide changes with coordinates relative to the leuB coding region. The LeuB enzymes in these spontaneous revertant strains have altered amino acid sequences in this region, but the changes from the native structure appear to allow sufficient function to support growth in leucine-free media. In spontaneous revertant MSC692, no compensating nucleotide changes in leuB were detected. The nature of the genetic change in this strain is uncharacterized.

In a second approach toward converting leucine auxotrophs to prototrophs, the spontaneous mutation in leuB of selected strains was specifically corrected to native sequence. PCR primers BLR513 (SEQ ID NO:173) and BLR516 (SEQ ID NO:174) were used to amplify a 646 base pair region of the native leuB gene using gDNA from wild type E. coli W3110 as template. The site of the base pair found deleted in MSC561 was 288 bp from the upstream end of this PCR fragment, and the PCR primers generate HindIII and XhoI ends for cloning into pMAK705 pl (Example 18; SEQ ID NO:157; FIG. 14Q) resulting in pBR1103 (SEQ ID NO:175; FIG. 14R). The leuB gene fragment in pBR1103 extends from the HindIII restriction site at bp=5059-5064 of SEQ ID NO:175 to the XhoI restriction site at bp=5712-5717 of SEQ ID NO:175. These restriction sites are not part of the natural leuB sequence but were introduced for cloning purposes by PCR with primers BLR513 and BLR516.

Standard "pop-in/pop-out" methodology was then used to replace the defective leuB region with the native region in auxotrophic strains MSC650, MSC679, and MSC700 to give prototrophic strains MSC722, MSC723, and MSC724, respectively. Briefly, initial transformants of MSC650, MSC679, and MSC700 with pBR1103 were selected on LB/Cm34 plates at 30° C. Selected tranformants were plated to LB/Cm34 at 43° C., and isolated survivors were confirmed by PCR to have pBR1103 integrated at the leuB locus. Selected integrants were grown in LB (no Cm) at 30° C. for about 10 generations, then in 2×M9 medium (no Cm, no leucine) for about 15 generations. Strains derived from colonies on LB plates isolated from these cultures were screened for chloramphenicol-sensitivity and prototrophy. DNA sequencing of the leuB gene in prototrophic, chloramphenicol-sensitive strains derived from each of the three initial parent strains confirmed that the original wild type sequence was restored. FIG. 15 shows the derivation of these strains in relation to other strains described herein.

TABLE 18

| strain | leucine phenotype | deletion (Δ) or insertion (Ω) in leuB; (leuB coordinates) | net bp change |
|---|---|---|---|
| W3110 | + | none | na |
| MSC651 | − | ΔC(383) | −1 |
| MSC650 | − | ΔC(383) | −1 |
| MSC669 | + | ΔC(383), ΔGG (345-346) | −3 |
| MSC670 | + | ΔC(383), ΔCTGTCCGCTGCGTG (360-373) | −15 |
| MSC671 | + | ΔC(383), ΩCGCAAACGGC (at 394) | +9 |
| MSC675 | + | ΔC(383), ΩT (at 340) | 0 |
| MSC677 | + | ΔC(383), ΩAACT (at 339) | +3 |
| MSC678 | + | ΔC(383), ΩG (at 345) | 0 |
| MSC691 | + | ΔC(383), ΩCATCCTG (at 410) | +6 |
| MSC692* | + | ΔC(383) | −1 |
| MSC693 | + | ΔC(383), ΔCA (374-375) | −3 |

TABLE 18-continued

| strain | leucine phenotype | deletion (Δ) or insertion (Ω) in leuB; (leuB coordinates) | net bp change |
|---|---|---|---|
| MSC694 | + | ΔC(383), ΩA (at 387) | 0 |
| MSC722 | + | none | 0 |
| MSC723 | + | none | 0 |
| MSC724 | + | none | 0 |

*No compensating changes in the leuB region were detected from about 200 bp upstream of the leuB start codon (i.e., the 3-prime end of leuA) to about 200 bp upstream of the leuB stop codon (i.e., leuB coordinates 1 to approx. 850 of the 1089 total base pairs of the leuB coding region).

rCH production in strains MSC722, MSC723, and MSC724 (the specifically-corrected Leu+prototrophs) was compared to production in strains with identical K4 gene complements and arrangements but derived by spontaneous conversion to prototrophy: MSC677, MSC692, and MSC702, respectively (see FIG. 15). The six strains were grown in duplicate 2×M9 flasks at 30° C. and induced with 1 mM mTA at OD600 values of approximately 0.1. Samples of culture broths at 71 hours post-induction were assayed for rCH content as described above. The average OD600 and rCH concentrations are shown in Table 19.

TABLE 19

| strain | Leu + | OD600 at 71 hr (each flask); average | rCH (μg/mL) (each flask); average |
|---|---|---|---|
| MSC677 | spontaneous | (7.63, 6.62); 7.12 | (362, 478); 420 |
| MSC722 | specific correction | (5.46, 5.20); 5.33 | (226, 230); 228 |
| MSC692 | spontaneous | (6.45, 8.50); 7.48 | (290, 339); 315 |
| MSC723 | specific correction | (7.90, 6.88); 7.39 | (450, 400); 425 |
| MSC702 | spontaneous | (6.20, 6.40); 6.30 | (344, 328); 336 |
| MSC724 | specific correction | (6.04, 6.75); 6.40 | (415, 428); 421 |

In two of the three strain pairs, rCH production is greater in the strain with the specific correction to leuB, but final cell density (as measured by terminal OD600) was similar. These results demonstrate the benefit in terms of rCH production of specifically correcting the spontaneous mutation discovered during the course of *E. coli* strain development.

Example 20

This Example Describes Recombinant DNA-mediated Production of Chondroitin in *E. coli* in Fermentors 1. 10-L Fermentation of *E. coli* (MSC537)

Using a 10-liter fermentor under typical fermentation conditions, a culture of *E. coli* strain MSC537 was cultivated using glycerine as a carbon source. The fermentor was batched with the following medium (Table 20A) to a volume of 6 liters using de-ionized water:

TABLE 20A

| Medium | |
|---|---|
| Component | Amount |
| NZ Amine HD | 320.0 g |
| Tastone 154 | 8.0 g |
| KH$_2$PO$_4$ | 80.0 g |

TABLE 20A-continued

| Medium | |
|---|---|
| Component | Amount |
| MgSO$_4$•7H$_2$O | 8.0 g |
| Na$_2$SO$_4$ | 48.0 g |
| Sodium citrate | 2.4 g |
| Dow 1520US antifoam | 0.8 mL |
| De-ionized water | As needed to reach 6.0 L |

After autoclaving of the fermentor containing the above medium, the following components (Table 20B) were added aseptically:

TABLE 20B

| Component | Amount |
|---|---|
| Glycerine (heat-sterilized) | 32.0 g |
| Thiamine HCl (filter-sterilized) | 320 μg |
| Trace Metal solution (filter-sterilized, recipe below) | 24 mL |

| Trace Metal Solution | |
|---|---|
| Component | Concentration |
| FeCl$_3$•6H$_2$O | 27 g/L |
| ZnCl$_2$ | 1.3 g/L |
| CoCl$_2$•6H$_2$O | 2.0 g/L |
| Na$_2$MoO$_4$•6H$_2$O | 2.0 g/L |
| CaCl$_2$•2H$_2$O | 2.5 g/L |
| MnCl$_2$•4H$_2$O | 3.3 g/L |
| H$_3$BO$_3$ | 0.5 g/L |
| HCl, concentrated | 160 mL/L |

The fermentor was inoculated with a typical seed culture and induced with 2 mM m-TA after 4.25 hours, then cultivated for 69 hours and fed a carbon feed (consisting of a 625 g/L glycerine solution) during cultivation. After 69 hours, the fermentor was autoclaved and harvested by centrifugation. The fermentation control conditions and product yield are shown in Tables 20C and 20D, respectively.

TABLE 20C

| Fermentation Control Conditions | |
|---|---|
| Temperature | 29.6-30.1° C. |
| pH | 7.08-7.30 |
| Agitation | 150-450 cps (cm per sec) |
| Dissolved oxygen | 50% (setpoint) |
| Airflow | 4.0-6.4 L/min |
| Oxygen flow | 0-1 L/min |
| Glycerine | 0-6 g/L (in-tank concentration) |
| Inoculum | 58 mL from shake flask, OD$_{600}$ = 6.9 |

TABLE 20D

| Product Yield | |
|---|---|
| Chondroitin yield | 4.50 g/L |
| Glycerine consumed | 185 g/L |
| Final OD$_{600}$ | 91 |

2. 2-L Fermentation of *E. coli* (MSC564)

Using a 2-liter fermentor under typical fermentation conditions, a culture of *E. coli* strain MSC564 was cultivated using glycerine as a carbon source. The fermentor was batched with the following medium (Table 21A) to a volume of 1.5 liters using de-ionized water:

TABLE 21A

| Medium | |
|---|---|
| Component | Amount |
| NZ Amine HD | 32.0 g |
| Tastone 154 | 0.8 g |
| KH$_2$PO$_4$ | 8.0 g |
| MgSO$_4$•7H$_2$O | 0.8 g |
| Na$_2$SO$_4$ | 4.8 g |
| Sodium citrate | 0.48 g |
| Dow 1520US antifoam | 0.16 mL |
| De-ionized water | As needed to reach 1.5 L |

After autoclaving of the fermentor containing the above medium, the following components (Table 21B) were added aseptically:

TABLE 21B

| Component | Amount |
|---|---|
| Glycerine (heat-sterilized) | 6.4 g |
| Thiamine HCl (filter-sterilized) | 64 μg |
| Tetracycline | 8.0 mg |
| Trace Metal solution (filter-sterilized, recipe below) | 4.8 mL |

| Trace Metal Solution | |
|---|---|
| Component | Concentration |
| FeCl$_3$•6H$_2$O | 27 g/L |
| ZnCl$_2$ | 1.3 g/L |
| CoCl$_2$•6H$_2$O | 2.0 g/L |
| Na$_2$MoO$_4$•6H$_2$O | 2.0 g/L |
| CaCl$_2$•2H$_2$O | 2.5 g/L |
| MnCl$_2$•4H$_2$O | 3.3 g/L |
| H$_3$BO$_3$ | 0.5 g/L |
| HCl, concentrated | 160 mL/L |

The fermentor was inoculated with a typical seed culture, then cultivated for 66 hours and fed 170 mL of a carbon feed (consisting of a 625 g/L glycerine solution) during cultivation. After 5 hours of cultivation, it was induced with 2 mM m-TA. The fermentation was controlled for pH, dissolved oxygen, temperature, glycerine concentration, and acetate concentration (byproduct of carbon metabolism). The glycerine feed rate was adjusted based on the acetate concentration with a target of <2 g/L acetate. The target glycerine concentration was <5 g/L. The fermentation was run for 66 hours, at which point, glycerine consumption declined to <1.5 g/L/hour. Due to sampling and evaporation, the final volume was 1.35 L. The control conditions and product yield are listed below. After 66 hours, the fermentor was autoclaved and harvested by centrifugation. The recovered volume after centrifugation was approximately 1 liter of supernatant. The fermentation control conditions and product yield are shown below in Tables 21C and 21D, respectively.

TABLE 21C

| Fermentation Control Conditions | |
|---|---|
| Temperature | 29.8-30.1° C. |
| pH | 7.1-7.30 |
| Agitation | 150-275 cps |
| Dissolved oxygen | 50% (setpoint) |
| Airflow | 0.7-1.2 L/min |
| Oxygen flow | 0.1-0.6 L/min |
| Glycerine | 0-12 g/L (in-tank concentration) |
| Inoculum | 8 mL from shake flask, OD$_{600}$ 10.2 (17.5 hour flask) |

TABLE 21D

| Product Yield | |
|---|---|
| Chondroitin yield | 6.2 g/L |
| Glycerine consumed | 79 g/L (1.35 L final vol.) |
| Final OD$_{600}$ | 22.3 |

The next three fermentations (3-5) were taken from one experiment where three 10 L reactors were run side-by-side under the same conditions comparing strains MSC619, MSC677 and MSC702 containing different numbers and arrangements of the region 2 gene set in the host chromosome (see Example 19; FIG. 15). Briefly, MSC619 and MSC677 each have three total copies of region 2, but one copy in MSC619 is driven by the Psyn promoter instead of the Pm promoter. Strain MSC702 has four copies of the region 2 gene set, all driven by Pm.

3. 10-L Fermentation of *E. coli* (MSC619)

Using a 10-liter fermentor under typical fermentation conditions, a culture of *E. coli* strain MSC619 was cultivated using glycerine, casein hydrolysate and ammonium hydroxide as the main carbon and nitrogen sources, respectively. The fermentor was batched with the following medium (Table 22A) to a volume of 6 liters using de-ionized water:

TABLE 22A

| Medium | |
|---|---|
| Component | Amount |
| NZ Amine HD | 160.0 g |
| Tastone 154 | 4.0 g |
| MgSO$_4$•7H$_2$O | 8.0 g |
| Na$_2$SO$_4$ | 24.0 g |
| Sodium citrate | 2.4 g |
| CaCl2*2H2O | 296 mg |
| Dow 1520US antifoam | 0.8 mL |
| De-ionized water | As needed to reach 6.0 L |

After autoclaving of the fermentor containing the above medium, the following components (Table 22B) were added aseptically:

TABLE 22B

| Component | Amount |
|---|---|
| Glycerine (heat-sterilized) | 48.0 g |
| KH$_2$PO$_4$ | 48.0 g |
| Thiamine HCl (filter-sterilized) | 320 μg |
| Trace Metal solution (filter-sterilized, recipe below) | 24 mL |

| Trace Metal Solution | |
|---|---|
| Component | Concentration |
| FeCl$_3$•6H$_2$O | 27 g/L |
| ZnCl$_2$ | 1.3 g/L |
| CoCl$_2$•6H$_2$O | 2.0 g/L |
| Na$_2$MoO$_4$•6H$_2$O | 2.0 g/L |
| CaCl$_2$•2H$_2$O | 2.5 g/L |
| MnCl$_2$•4H$_2$O | 3.3 g/L |
| H$_3$BO$_3$ | 0.5 g/L |
| Citric acid | 33 g/L |

The fermentor was inoculated with a typical seed culture and induced with 2 mM m-TA after 4.2 hours, then cultivated for 80 hours and fed a carbon feed (consisting of a 625 g/L glycerine solution) and a nitrogen feed in the form of 4N ammonium hydroxide. The carbon and nitrogen feeds were adjusted manually based on sample readings taken offline on the NOVA 300A Bioanalyzer. The concentration of glycerine was targeted to maintain less than 1 g/L and the feedrate was reduced further in the presence of acetate accumulation. The ammonia concentration target was 100 mg/L or less of ammonia in the broth. Acid in the form of 2N sulfuric acid and base in the form of 4N sodium hydroxide were added automatically during cultivation to control pH. Antifoam was also fed automatically to the fermentor to control foaming of the broth. The fermentation control conditions and product yield are shown below in Tables 22C and 22D, respectively.

TABLE 22C

| Fermentation Control Conditions | |
|---|---|
| Temperature | 29.9-30.1° C. |
| pH | 7.2-7.3 |
| Agitation | 150-360 cps |
| Dissolved oxygen | 50% (setpoint) |
| Airflow | 5.3-6.4 L/min |
| Oxygen flow | 0-1.1 L/min |
| Glycerine | 0-9.1 g/L (in-tank concentration) |
| Inoculum | 50 mL from shake flask, $OD_{600}$ = 7.2 |

TABLE 22D

| Product Yield | |
|---|---|
| Chondroitin yield | 3.45 g/L (7.3 L final volume) |
| Glycerine consumed | 135 g/L |
| Final $OD_{600}$ | 64 |

4. 10-L Fermentation of *E. coli* (MSC677)

Using a 10-liter fermentor under typical fermentation conditions, a culture of *E. coli* strain MSC677 was cultivated using glycerine, casein hydrolysate and ammonium hydroxide as the main carbon and nitrogen sources, respectively. The fermentor was batched with the following medium (Table 23A) to a volume of 6 liters using de-ionized water.

TABLE 23A

| Medium | |
|---|---|
| Component | Amount |
| NZ Amine HD | 160.0 g |
| Tastone 154 | 4.0 g |
| $MgSO_4 \cdot 7H_2O$ | 8.0 g |
| $Na_2SO_4$ | 24.0 g |
| Sodium citrate | 2.4 g |
| CaCl2*2H2O | 296 mg |
| Dow 1520US antifoam | 0.8 mL |
| De-ionized water | As needed to reach 6.0 L |

After autoclaving of the fermentor containing the above medium, the following components (Table 23B) were added aseptically:

TABLE 23B

| Component | Amount |
|---|---|
| Glycerine (heat-sterilized) | 48.0 g |
| $KH_2PO_4$ | 48.0 g |
| Thiamine HCl (filter-sterilized) | 320 μg |
| Trace Metal solution (filter-sterilized, recipe below) | 24 mL |

TABLE 23B-continued

| Trace Metal Solution | |
|---|---|
| Component | Concentration |
| $FeCl_3 \cdot 6H_2O$ | 27 g/L |
| $ZnCl_2$ | 1.3 g/L |
| $CoCl_2 \cdot 6H_2O$ | 2.0 g/L |
| $Na_2MoO_4 \cdot 6H_2O$ | 2.0 g/L |
| $CaCl_2 \cdot 2H_2O$ | 2.5 g/L |
| $MnCl_2 \cdot 4H_2O$ | 3.3 g/L |
| $H_3BO_3$ | 0.5 g/L |
| Citric acid | 33 g/L |

The fermentor was inoculated with a typical seed culture and induced with 2 mM m-TA after 4.2 hours, then cultivated for 80 hours and fed a carbon feed (consisting of a 625 g/L glycerine solution), and a nitrogen feed in the form of 4N ammonium hydroxide. The carbon and nitrogen feeds were adjusted manually based on sample readings taken offline on the NOVA 300A Bioanalyzer. The concentration of glycerine was targeted to maintain less than 1 g/L and the feed rate was reduced further in the presence of acetate accumulation. The ammonia concentration target was 100 mg/L or less of ammonia in the broth. Acid in the form of 2N sulfuric acid and base in the form of 4N sodium hydroxide were added automatically during cultivation to control pH. Antifoam was also fed automatically to the fermentor to control foaming of the broth. The fermentation control conditions and product yield are shown in Tables 23C and 23D, respectively.

TABLE 23C

| Fermentation Control Conditions | |
|---|---|
| Temperature | 29.7-30.2° C. |
| pH | 6.98-7.37 |
| Agitation | 150-440 cps |
| Dissolved oxygen | 50% (setpoint) |
| Airflow | 5.0-6.4 L/min |
| Oxygen flow | 0-1.9 L/min |
| Glycerine | 0-7.5 g/L (in-tank concentration) |
| Inoculum | 50 mL from shake flask, $OD_{600}$ = 6.7 |

TABLE 23D

| Product Yield | |
|---|---|
| Chondroitin yield | 4.3 g/L (8.4 L final volume) |
| Glycerine consumed | 143 g/L |
| Final $OD_{600}$ | 57 |

5. 10-L Fermentation of *E. coli* (MSC702)

Using a 10-liter fermentor under typical fermentation conditions, a culture of *E. coli* strain MSC702 was cultivated using glycerine, casein hydrolysate and ammonium hydroxide as the main carbon and nitrogen sources, respectively. The fermentor was batched with the following medium (Table 24A) to a volume of 6 liters using de-ionized water.

TABLE 24A

| Medium | |
|---|---|
| Component | Amount |
| NZ Amine HD | 160.0 g |
| Tastone 154 | 4.0 g |
| $MgSO_4 \cdot 7H_2O$ | 8.0 g |
| $Na_2SO_4$ | 24.0 g |

TABLE 24A-continued

Medium

| Component | Amount |
|---|---|
| Sodium citrate | 2.4 g |
| CaCl2*2H2O | 296 mg |
| Dow 1520US antifoam | 0.8 mL |
| De-ionized water | As needed to reach 6.0 L |

After autoclaving of the fermentor containing the above medium, the following components (Table 24B) were added aseptically.

TABLE 24B

| Component | Amount |
|---|---|
| Glycerine (heat-sterilized) | 48.0 g |
| $KH_2PO_4$ | 48.0 g |
| Thiamine HCl (filter-sterilized) | 320 μg |
| Trace Metal solution (filter-sterilized, recipe below) | 24 mL |

Trace Metal Solution

| Component | Concentration |
|---|---|
| $FeCl_3 \cdot 6H_2O$ | 27 g/L |
| $ZnCl_2$ | 1.3 g/L |
| $CoCl_2 \cdot 6H_2O$ | 2.0 g/L |
| $Na_2MoO_4 \cdot 6H_2O$ | 2.0 g/L |
| $CaCl_2 \cdot 2H_2O$ | 2.5 g/L |
| $MnCl_2 \cdot 4H_2O$ | 3.3 g/L |
| $H_3BO_3$ | 0.5 g/L |
| Citric acid | 33 g/L |

The fermentor was inoculated with a typical seed culture and induced with 2 mM m-TA after 4.2 hours, then cultivated for 80 hours and fed a carbon feed (consisting of a 625 g/L glycerine solution), and a nitrogen feed in the form of 4N ammonium hydroxide. The carbon and nitrogen feeds were adjusted manually based on sample readings taken offline on the NOVA 300A Bioanalyzer. The concentration of glycerine was targeted to maintain less than 1 g/L and the feed rate was reduced further in the presence of acetate accumulation. The ammonia concentration target was 100 mg/L or less of ammonia in the broth. Acid in the form of 2N sulfuric acid and base in the form of 4N sodium hydroxide were added automatically during cultivation to control pH. Antifoam was also fed automatically to the fermentor to control foaming of the broth. The fermentation control conditions and product yield are shown in Tables 24C and 24D, respectively.

TABLE 24C

Fermentation Control Conditions

| | |
|---|---|
| Temperature | 29.8-30.2° C. |
| pH | 6.8-7.3 |
| Agitation | 150-490 cps |
| Dissolved oxygen | 50% (setpoint) |
| Airflow | 4.0-6.4 L/min |
| Oxygen flow | 0-2.4 L/min |
| Glycerine | 0-7.0 g/L (in-tank concentration) |
| Inoculum | 50 mL from shake flask, $OD_{600}$ = 6.7 |

TABLE 24D

Product Yield

| | |
|---|---|
| Chondroitin yield | 5.3 g/L (8.9 L final volume) |
| Glycerine consumed | 151 g/L |
| Final $OD_{600}$ | 60 |

To summarize experiments 3-5, strains MSC619, MSC677, and MSC702 yielded 3.45, 4.3 and 5.3 g/L chondroitin, respectively, demonstrating the effects of region 2 arrangement (context) and copy number in enhancing chondroitin productivities.

6. 10-L Fermentation of *E. coli* (MSC702)

Using a 10-liter fermentor under typical fermentation conditions, a culture of *E. coli* strain MSC702 was cultivated using glycerine, casein hydrolysate and ammonium hydroxide as the main carbon and nitrogen sources, respectively. The fermentor was batched with the following medium (Table 25A) to a volume of 6 liters using de-ionized water.

TABLE 25A

Medium

| Component | Amount |
|---|---|
| NZ Amine HD | 160.0 g |
| Tastone 154 | 4.0 g |
| $MgSO_4 \cdot 7H_2O$ | 8.0 g |
| $Na_2SO_4$ | 24.0 g |
| Sodium citrate | 2.4 g |
| CaCl2*2H2O | 296 mg |
| Dow 1520US antifoam | 0.8 mL |
| De-ionized water | As needed to reach 6.0 L |

After autoclaving of the fermentor containing the above medium, the following components (Table 25B) were added aseptically.

TABLE 25B

| Component | Amount |
|---|---|
| Glycerine (heat-sterilized) | 48.0 g |
| $KH_2PO_4$ | 48.0 g |
| Thiamine HCl (filter-sterilized) | 320 μg |
| Trace Metal solution (filter-sterilized, recipe below) | 24 mL |

Trace Metal Solution

| Component | Concentration |
|---|---|
| $FeCl_3 \cdot 6H_2O$ | 27 g/L |
| $ZnCl_2$ | 1.3 g/L |
| $CoCl_2 \cdot 6H_2O$ | 2.0 g/L |
| $Na_2MoO_4 \cdot 6H_2O$ | 2.0 g/L |
| $CaCl_2 \cdot 2H_2O$ | 2.5 g/L |
| $MnCl_2 \cdot 4H_2O$ | 3.3 g/L |
| $H_3BO_3$ | 0.5 g/L |
| Citric acid | 33 g/L |

The fermentor was inoculated with a typical seed culture and induced with 2 mM m-TA after 4 hours, then cultivated for 82 hours and fed a carbon feed (consisting of a 625 g/L glycerine solution), and a nitrogen feed in the form of 4N ammonium hydroxide. The carbon and nitrogen feeds were adjusted manually based on sample readings taken offline on the NOVA 300A Bioanalyzer. The concentration of glycerine was targeted to maintain less than 1 g/L and the feed rate was reduced further in the presence of acetate accumulation. The ammonia concentration target was 100 mg/L or less of ammonia in the broth. Acid in the form of 2N sulfuric acid and base in the form of 4N sodium hydroxide were added automatically during cultivation to control pH. Antifoam was also fed automatically to the fermentor to control foaming of the broth. The fermentation control conditions and product yield are shown in Tables 25C and 25D, respectively.

TABLE 25C

Fermentation Control Conditions

| | |
|---|---|
| Temperature | 29.8-30.2° C. |
| pH | 7.1-7.3 |
| Agitation | 150-480 cps |
| Dissolved oxygen | 50% (setpoint) |
| Airflow | 3.4-6.4 L/min |
| Oxygen flow | 0-3.1 L/min |
| Glycerine | 0-7.7 g/L (in-tank concentration) |
| Inoculum | 50 mL from shake flask, $OD_{600}$ = 9.0 |

TABLE 25D

Product Yield

| | |
|---|---|
| Chondroitin yield | 8.3 g/L (8.4 L final volume) |
| Glycerine consumed | 123 g/L |
| Final $OD_{600}$ | 69 |

This run was designed as a repetition of fermentation experiment 5 (above) but achieved a significant increase in chondroitin yield. The difference in yield is at least partly believed to be due to excess antifoam used in experiment 5 along with an increased level of acetate build up, both of which are considered to negatively affect chondroitin yield.

7. 50-L Fermentation of E. coli (MSC702)

Using a 50-liter fermentor under typical fermentation conditions, a culture of E. coli strain MSC702 was cultivated in a defined medium using glycerine, and ammonium hydroxide as the main carbon and nitrogen sources, respectively. The fermentor was batched with the following medium (Table 26A) to a volume of 40 liters using de-ionized water.

TABLE 26A

Medium

| Component | Amount |
|---|---|
| NaCl | 50.0 g |
| NH4Cl | 100.0 g |
| MgSO4•7H2O | 12.0 g |
| CaCl2*2H2O | 1.85 g |
| Dow 1520US antifoam | 5.0 mL |
| De-ionized water | As needed to reach 40.0 L |

After autoclaving of the fermentor containing the above medium, the following components (Table 26B) were added aseptically.

TABLE 26B

| Component | Amount |
|---|---|
| Glycerine (heat-sterilized) | 300 g |
| Na2HPO4 | 240 g |
| KH$_2$PO$_4$ | 120 g |
| Thiamine HCl (filter-sterilized) | 2 mg |
| Trace Metal solution (filter-sterilized, recipe below) | 150 mL |

TABLE 26B-continued

Trace Metal Solution

| Component | Concentration |
|---|---|
| $FeCl_3$•$6H_2O$ | 27 g/L |
| $ZnCl_2$ | 1.3 g/L |
| $CoCl_2$•$6H_2O$ | 2.0 g/L |
| $Na_2MoO_4$•$6H_2O$ | 2.0 g/L |
| $CaCl_2$•$2H_2O$ | 2.5 g/L |
| $MnCl_2$•$4H_2O$ | 3.3 g/L |
| $H_3BO_3$ | 0.5 g/L |
| Citric acid | 33 g/L |

The fermentor was inoculated with a typical seed culture and induced with 2 mM m-TA after 4 hours, then cultivated for 91 hours and fed a carbon feed (consisting of a 625 g/L glycerine solution), and a nitrogen feed in the form of 6N ammonium hydroxide. The carbon and nitrogen feeds were adjusted manually based on sample readings taken offline on the NOVA 300A Bioanalyzer. The concentration of glycerine was targeted to maintain less than 1 g/L and the feed rate was reduced further in the presence of acetate accumulation. The ammonia concentration target was 100 mg/L or less of ammonia in the broth. Acid in the form of 3N sulfuric acid and base in the form of 4N sodium hydroxide were added automatically during cultivation to control pH. Antifoam was fed manually to the fermentor to control foaming of the broth. The fermentation control conditions and product yield are shown in Tables 26C and 26D, respectively.

TABLE 26C

Fermentation Control Conditions

| | |
|---|---|
| Temperature | 30° C. setpoint |
| pH | 7.2 setpoint |
| Agitation | 150-375 cps |
| Dissolved oxygen | 50% setpoint |
| Airflow | 30-40 L/min |
| Oxygen flow | 0-10 L/min |
| Glycerine | 0-7.8 g/L (in-tank concentration) |
| Inoculum | 1000 mL from 2 L fermentor, $OD_{600}$ = 6.9 |

TABLE 26D

Product Yield

| | |
|---|---|
| Chondroitin yield | 4.7 g/L (52 L final volume) |
| Glycerine consumed | 143 g/L |
| Final $OD_{600}$ | 114 |

This fermentation experiment demonstrates that high chondroitin production was achieved in defined (minimal) growth medium at intermediate fermentation scale.

The next two fermentations (8-9) were taken from one experiment where two 10 L reactors were run side by side under the same conditions comparing strains MSC702 and MSC724.

8. 10-L Fermentation of E. coli (MSC702)

Using a 10-liter fermentor under typical fermentation conditions, a culture of E. coli strain MSC702 was cultivated using glycerine, casein hydrolysate and ammonium sulfate as the main carbon and nitrogen sources, respectively. The fermentor was batched with the following medium (Table 27A) to a volume of 6 liters using de-ionized water.

TABLE 27A

| Component | Amount |
|---|---|
| NZ Amine HD | 160.0 g |
| Tastone 154 | 4.0 g |
| $MgSO_4 \cdot 7H_2O$ | 8.0 g |
| $Na_2SO_4$ | 24.0 g |
| Sodium citrate | 2.4 g |
| $CaCl2*2H2O$ | 296 mg |
| Dow 1520US antifoam | 0.8 mL |
| De-ionized water | As needed to reach 6.0 L |

After autoclaving of the fermentor containing the above medium, the following components (Table 27B) were added aseptically.

TABLE 27B

| Component | Amount |
|---|---|
| Glycerinr (heat-sterilized) | 48.0 g |
| $KH_2PO_4$ | 48.0 g |
| Thiamine HCl (filter-sterilized) | 320 µg |
| Trace Metal solution (filter-sterilized, recipe below) | 24 mL |

| Trace Metal Solution | |
|---|---|
| Component | Concentration |
| $FeCl_3 \cdot 6H_2O$ | 27 g/L |
| $ZnCl_2$ | 1.3 g/L |
| $CoCl_2 \cdot 6H_2O$ | 2.0 g/L |
| $Na_2MoO_4 \cdot 6H_2O$ | 2.0 g/L |
| $CaCl_2 \cdot 2H_2O$ | 2.5 g/L |
| $MnCl_2 \cdot 4H_2O$ | 3.3 g/L |
| $H_3BO_3$ | 0.5 g/L |
| Citric acid | 33 g/L |

The fermentor was inoculated with a typical seed culture and induced with 2 mM m-TA after 4 hours, then cultivated for 92 hours and fed a carbon feed (consisting of a 625 g/L glycerine solution), and a nitrogen feed in the form of ammonium sulfate. The carbon and nitrogen feeds were adjusted manually based on sample readings taken offline on the NOVA 300A Bioanalyzer. The concentration of glycerine in the broth was targeted to maintain less than 1 g/L and the feed rate was reduced further in the prescence of acetate accumulation. The ammonia concentration target was 100 mg/L or less of ammonia in the broth. Acid in the form of 2N sulfuric acid and base in the form of 4N sodium hydroxide were added automatically during cultivation to control pH. Antifoam was also fed automatically to the fermentor to control foaming of the broth. The fermentation control conditions and product yield are shown in Tables 27C and 27D, respectively.

TABLE 27C

| Fermentation Control Conditions | |
|---|---|
| Temperature | 29.9-30.1° C. |
| pH | 7.2-7.3 |
| Agitation | 150-460 cps |
| Dissolved oxygen | 50% (setpoint) |
| Airflow | 5.0-6.4 L/min |
| Oxygen flow | 0-1.4 L/min |
| Glycerine | 0.2-11.4 g/L (in-tank concentration) |
| Inoculum | 100 mL from shake flask, $OD_{600}$ = 1.7 |

TABLE 27D

| Product Yield | |
|---|---|
| Chondroitin yield | 7.9 g/L (7.8 L final volume) |
| Glycerine consumed | 128 g/L |
| Final $OD_{600}$ | 50 |

9) 10-L Fermentation of *E. coli* (MSC724)

Using a 10-liter fermentor under typical fermentation conditions, a culture of *E. coli* strain MSC724 was cultivated using glycerine, casein hydrolysate and ammonium sulfate as the main carbon and nitrogen sources, respectively. The fermentor was batched with the following medium (Table 28A) to a volume of 6 liters using de-ionized water.

TABLE 28A

| Component | Amount |
|---|---|
| NZ Amine HD | 160.0 g |
| Tastone 154 | 4.0 g |
| $MgSO_4 \cdot 7H_2O$ | 8.0 g |
| $Na_2SO_4$ | 24.0 g |
| Sodium citrate | 2.4 g |
| $CaCl2*2H2O$ | 296 mg |
| Dow 1520US antifoam | 0.8 mL |
| De-ionized water | As needed to reach 6.0 L |

After autoclaving of the fermentor containing the above medium, the following components (Table 28B) were added aseptically.

TABLE 28B

| Component | Amount |
|---|---|
| Glycerine (heat-sterilized) | 48.0 g |
| $KH_2PO_4$ | 48.0 g |
| Thiamine HCl (filter-sterilized) | 320 µg |
| Trace Metal solution (filter-sterilized, recipe below) | 24 mL |

| Trace Metal Solution | |
|---|---|
| Component | Concentration |
| $FeCl_3 \cdot 6H_2O$ | 27 g/L |
| $ZnCl_2$ | 1.3 g/L |
| $CoCl_2 \cdot 6H_2O$ | 2.0 g/L |
| $Na_2MoO_4 \cdot 6H_2O$ | 2.0 g/L |
| $CaCl_2 \cdot 2H_2O$ | 2.5 g/L |
| $MnCl_2 \cdot 4H_2O$ | 3.3 g/L |
| $H_3BO_3$ | 0.5 g/L |
| Citric acid | 33 g/L |

The fermentor was inoculated with a typical seed culture and induced with 2 mM m-TA after 4 hours, then cultivated for 92 hours and fed a carbon feed (consisting of a 625 g/L glycerine solution), and a nitrogen feed in the form of ammonium sulfate. The carbon and nitrogen feeds were adjusted manually based on sample readings taken offline on the NOVA 300A Bioanalyzer. The concentration of glycerine in the broth was targeted to maintain less than 1 g/L and the feed rate was reduced further in the prescence of acetate accumulation. The ammonia concentration target was 100 mg/L or less of ammonia in the broth. Acid in the form of 2N sulfuric acid and base in the form of 4N sodium hydroxide were added automatically during cultivation to control pH. Antifoam was also fed automatically to the fermentor to control foaming of the broth. The fermentation control conditions and product yield are shown in Tables 28C and 28D, respectively.

TABLE 28C

Fermentation Control Conditions

| | |
|---|---|
| Temperature | 29.8-30.2° C. |
| pH | 7.2-7.3 |
| Agitation | 150-480 cps |
| Dissolved oxygen | 50% (setpoint) |
| Airflow | 5.0-6.4 L/min |
| Oxygen flow | 0-1.4 L/min |
| Glycerine | 0.2-9.8 g/L (in-tank concentration) |
| Inoculum | 50 mL from shake flask, $OD_{600}$ = 7.7 |

TABLE 28C

Product Yield

| | |
|---|---|
| Chondroitin yield | 9.3 g/L (8.0 L final volume) |
| Glycerine consumed | 122 g/L |
| Final $OD_{600}$ | 47 |

Fermentations 8 and 9 in this Example demonstrate an improved rCH yield of strain MSC724 over MSC702 in complex medium. This may be the result of greater metabolic efficiency of the native LeuB enzyme in MSC724 compared to the functional, but altered LeuB enzyme, in MSC702 (see Example 19).

Example 21

This Example Describes the Recombinant DNA-mediated Production of Chondroitin in *X. campestris* in Fermentors 10-L Fermentation of *X. campestris* (MSC480)

Using a 10-liter fermentor under typical fermentation conditions a culture of *Xanthomonas campestris* strain MSC480 was cultivated using glucose as a carbon source. The fermentor was batched with the following medium (Table 29A) to a volume of 7.5 liters using de-ionized water:

TABLE 29A

Medium

| Component | Amount |
|---|---|
| Malt Extract | 200.0 g |
| Tastone 154 | 80.0 g |
| $KH_2PO_4$ | 17.0 g |
| $MgSO_4 \cdot 7H_2O$ | 5.0 g |
| $Na_2SO_4$ | 1.0 g |
| $CaCl_2 \cdot 2H_2O$ | 0.5 g |
| Citric acid | 20.0 g |
| $H_3BO_3$ | 60 mg |
| $ZnCl_2$ | 100 mg |
| $FeCl_3 \cdot 6H_2O$ | 200 mg |
| Dow 1520US antifoam | 2 mL |
| De-ionized water | As needed to reach 7.5 L |

After autoclaving of the fermentor containing the above medium, 60 g of glucose (heat-sterilized) was added aseptically.

The fermentor was inoculated with a typical seed culture, then cultivated for 70 hours and fed a carbon feed (consisting of an 871 g/L glucose solution) during cultivation. After 70 hours, the fermentor was autoclaved and harvested by centrifugation. The fermentation control conditions and product yield are shown in Tables 29B and 29C, respectively.

TABLE 29B

Fermentation Control Conditions

| | |
|---|---|
| Temperature | 29.9-30.1° C. |
| pH | 6.70-7.11 |
| Agitation | 150-250 cps |
| Dissolved oxygen | 20% (setpoint) |
| Airflow | 5.0-8.0 L/min |
| Glucose | 13-27 g/L (in-tank concentration) |
| Inoculum | 850 mL from 2-L fermentor, $OD_{600}$ = 5.9 |

TABLE 29C

Product Yield

| | |
|---|---|
| Chondroitin yield | 1.86 g/L |
| Glucose consumed | 19 g/L |
| Final $OD_{600}$ | 18 |

Example 22

This Example Illustrates an Improved *E. coli* Growth Medium

Examples 4, 7, and 8 above describe the use of complex TB medium for growth of rCH-producing recombinant *E. coli* K-12 strains. As normally formulated, TB medium contains 5 g/L glycerine as the primary carbon source. This example describes modifications to TB medium that enhance rCH volumetric and specific productivities in shake flasks.

A small culture of strain MSC564 was developed in TB/Tc5 medium at 30° C. for use as inocula. Standard TB medium (Sambrook et al., 1989; Difco "Terrific Broth") was modified with 0.1 M MOPS buffer (4-morpholinepropanesulfonic acid; prepared from a 1.0M stock solution pH-adjusted to 7.2 with NaOH), 10 vg/L glycerine (2× normal TB recipe), or both. Erlenmeyer shake flasks (250 mL) containing 50 mL of each medium were inoculated with the MSC564 culture to achieve OD600=0.03. The flasks were shaken (225 rpm) at 30° C. until OD600 values reached approx. 0.125, at which time meta-toluic acid was added to 1 mM to induce rCH production. After 72 hours of continued shaking, pH and OD600 measurements were taken, and 5 mL aliquots were autoclaved for 5-7 min., cooled and stored frozen. rCH contents were determined as described in Example 14. The final OD600 and rCH concentrations are shown in Table 30.

TABLE 30

| medium | final pH | final OD600 | rCH (µg/mL) |
|---|---|---|---|
| TB | 8.3 | 13.4 | 1017 |
| TB/0.1M MOPS pH 7.2 | 8.1 | 8.53 | 1244 |
| TB/2× glycerine (10 g/L) | 6.0 | 9.64 | 676 |
| TB/MOPS/glycerine | 7.4 | 12.2 | 1592 |

TB medium buffered and amended with extra glycerine (2× normal) resulted in a >50% increase in rCH titer (greater volumetric productivity) without additional cell density (greater specific productivity). Growth and productivity in medium with 2× glycerine but without buffer resulted in poor productivity, likely due to excess acid production from glycerine. This demonstrates increased production capacity in recombinant strains and provides higher productivity growth conditions under which to evaluate new *E. coli* strains.

The foregoing description of the present invention has been presented for purposes of illustration and description. Furthermore, the description is not intended to limit the invention to the form disclosed herein.

All of the various aspects, embodiments, and options described herein can be combined in any and all variations.

All publications, patents, and patent applications mentioned in this specification are herein incorporated by reference to the same extent as if each individual publication, patent, or patent application was specifically and individually indicated to be incorporated by reference.

SEQUENCE LISTING (175 sequences)

SEQ ID NO: 1 - DNA, 981 bp, Artificial Sequence
  Synthetic Sequence
atgagcgaacgccacttgccggatgaccagtcctcgaccattgatccgtatctgattacgagcgtccgccagaccctggccgaacaaagcgcggcactgcaaaacctgtccaaacaactggatagcggtcagtaccagcgcgtcctgaatctcatcatgaattgtaaagggcacgtcatcctgagcggcatgggtaaaagcggccatgtgggccgcaagatgtcggcgaccttggcctcgaccgggacgccctccttctttattcatccggcggaagcgttccatggtgatctgggcatgatcaccccgtatgacctgctcatcttgatttcggcgagcggtgagacggacgagatcctgaaactggtgccgagcctgaagaacttcggcaatcgcatcatcgcaatcaccaataacgggaatagcaccctggccaaaaatgcagatgcggtcctggagctgcacatggcgaacgaaacgtgcccgaacaatctcgccccgaccacctccacgacgctcacgatggcgatcggggacgcgctggccatcgcgatgattcaccagcgtaagtttatgcccaatgactttgcacgctaccaccccggtggcagcctgggtcggcgcctgctgacccgcgtcgccgacgtgatgcaacatgatgtgccggcagtgcagctcgatgccagcttcaaaacggtcattcagcgcatcacctcgggctgccagggtatggtgatggtcgaagatgcggaaggtgggctggcaggcatcatcaccgatggcgatctgcggcgctttatggagaaagaagacagcctgacgagcgcaacggccgcacagatgatgacccgcgaaccgctgaccttgcccgaagacaccatgatcatcgaagcagaagagaagatgcagaaacaccgcgtctcgaccctgctggtgaccaacaaagcaaataaggtgaccgggttggtgcgcattttcgat

SEQ ID NO: 2 - protein, 327 aa, Escherichia coli
MSERHLPDDQSSTIDPYLITSVRQTLAEQSAALQNLSKQLDSGQYQRVLNLIMNCKGHVILSGMGKSGHVGRKMSATLASTGTPSFFIHPAEAFHGDLGMITPYDLLILISASGETDEILKLVPSLKNFGNRIIAITNNGNSTLAKNADAVLELHMANETCPNNLAPTTSTTLTMAIGDALAIAMIHQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKHRVSTLLVTNKANKVTGLVRIFD

SEQ ID NO: 3 - DNA, 1146 bp, Artificial Sequence
  Synthetic Sequence
atgctgatcaaagtgaaaagcgccgtctcgtggatgcgtgcgcgtctgagcgcgatcagcctggcagatattcagaagcacctggcaaaaatcattattctggcacccatggcggtgctgctgatctacttggcgatcttctcccagccccgctatatgtcggaaagcaaggtggccatcaagcgcagcgacgatctcaactccggcagcctgaacttcggcctgctgttgggtgcctccaacccgtcgtccgccgaagacgcactgtacctgaaggaatacatcaacagcccggatatgctggccgcgctggataaacagctgaacttccgcgaagcgttctcccattcgggcctggacttcctgaaccatctgtccaaggatgaaaccgccgaggggttcctgaagtactataaagatcgcatcaacgtcagctacgacgacaagaccgggctgctgaacatccagacccagggcttttcgcccgagttcgcgctgaaattcaaccagaccgtgctcaaggaatccgagcggttcatcaatgaaatgtcgcaccgtatcgcccgcgatcaattggcgtttgcggaaaccgaaatggaaaaagcgcgccagcggctggatgcatcgaaagccgaattgttgtcctaccaagacaacaacaatgtgctggacccgcaggcacaggcccaggcggcatccaccctggtgaatacgctgatgggccagaaaattcagatggaagccgacctgcgcaacctgctcacgtacctgcgcgaggatgcgccccaagtcgtgagcgcccgcaatgcaattcagagcctccaggcacagatcgacgaagaaaagtcgaaaattaccgcaccccagggcgataaactgaaccgcatggccgtggattttgaggagatcaaatccaaggtcgagttcaataccgagttgtacaagctcacgctcaccagcatcgaaaagacccgtgtcgaagcggcccgtaagctgaaagtcctgagcgtgatctcgtccccgcagctgccccaggaaagctccttcccgaatatcccgtatttgatcgcgtgttggctgctggtgtgttgcctgctctttggcaccctgaaattgctcctggcggtgattgaagaccaccgtgac

SEQ ID NO: 4 - protein, 382 aa, Escherichia coli
MLIKVKSAVSWMRARLSAISLADIQKHLAKIIILAPMAVLLIYLAIFSQPRYMSESKVAIKRSDDLNSGSLNFGLLLGASNPSSAEDALYLKEYINSPDMLAALDKQLNFREAFSHSGLDFLNHLSKDETAEGFLKYYKDRINVSYDDKTGLLNIQTQGFSPEFALKFNQTVLKESERFINEMSHRIARDQLAFAETEMEKARQRLDASKAELLSYQDNNNVLDPQAQAQAASTLVNTLMGQKIQMEADLRNLLTYLREDAPQVVSARNAIQSLQAQIDEEKSKITAPQGDKLNRMAVDFEEIKSKVEFNTELYKLTLTSIEKTRVEAARKLKVLSVISSPQLPQESSFPNIPYLIACWLLVCCLLFGTLKLLLAVIEDHRD

SEQ ID NO: 5 - DNA, 1674 bp, Artificial Sequence
  Synthetic Sequence
atgaagctgtttaagtcgatcctgctgatcgcagcgtgccatgcagcacaggcgagcgcaaccatcgacattaatgccgatccgaacctcacgggtgccgcaccgttgaccggcatcctgaacgggcagaaaagcgacacccagaacatgagcggcttcgataacaccccgccccccgcacccccggtcgtgatgagccgtatgttcggggcgcagctgttcaacggtacgagcgcagactcgggggcaaccgtgggtttcaatccggactacatcctgaatcccggcgattccatccaggtccgcctgtggggtgcgttcaccttcgatggcgcactccaggtggacccgaagggcaacatcttcctgccgaatgtcggccccgtcaaagtcgcaggtgtgtcgaactcccagttgaacgcgctggtgacgagcaaggtgaaggaagtctaccagagcaacgtgaacgtctatgcgtcgctcttgcaggcgcagccggtcaaggtctatgtgaccggctttgtccgcaaccccggcctgtacggcggtgtcacctccgacagcctgctgaactacctgatcaaggcgggtggtgtggacccggaacgcggcagctacgtggacatcgtcgtgaaacgcggcaatcgtgtgcgctcgaacgtcaacctctatgacttcctgctcaacggcaaactggggctgtcccagtttgcggacggtgatacgatcattgtgggtccgcgccagcatacgttctcggtgcagggcgatgtgttcaattcctacgactttgaatttcgcgaatcgagcatcccggtcaccgaagcactgtcctgggcacgtcccaaaccgggtgcgacccatatcacgattatgcggaagcagggcctccagaagcgctcggaatattatccgatctcgtccgcaccggggcgtatgctgcaaaacggtgataccctcattgtctccaccgaccgctatgcgggcaccattcaagtgcgtgtggaaggcgcacattccggggaacacgccatggtgctgccctacggtagcaccatgcgggccgtgctcgaaaaagtgcgcccgaactccatgtcgcagatgaacgccgtgcagttgtatcggccgagcgtcgcgcaacggcagaaagaaatgctgaatttgtccctgcaaaagctcgaagaggccagcctcagcgcacagagcagcaccaaggaagaggccagcctgcgtatgcaggaagcccaactgatctcccgcttcgtcgcgaaagcccgcaccgtcgtgccgaagggcgaagtgatcctcaatgaaagcaacattgactccgtcctcctggaggacggcgacgtgatcaatattcccgaaaagacgtcgttggtcatggtccacggggaagtgctgttcccgaacgcggtgtcgtggcagaaaggtatgacgaccgaggactacatcgagaagtgcggtgggctgacccagaagtccggcaacgcccgtattatcgtcatccgtcagaacggcgcagcggtgaacgcagaagacgtcgattccctgaaacccggtgatgaaattatggtgttgccgaaatacgagtcgaagaacatcgaagtgacgcgcggtatcagcaccattctgtaccaactggcggtgggcgcgaaagtgattctgtcgctg

SEQ ID NO: 6 - protein, 558 aa, Escherichia coli
MKLFKSILLIAACHAAQASATIDINADPNLTGAAPLTGILNGQKSDTQNMSGFDNTPPPAPPVVMSRMFGAQLFNGTSADSGATVGFNPDYILNPGDSIQVRLWGAFTFDGALQVDPKGNIFLPNVGPVKVAGVSNSQLNALVTSKVKEVYQSNVNVYASLLQAQPVKVYVTGFVRNPGLYGGVTSDSLLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEASLRMQEAQLISRFVAKARTVVPKGEVILNESNIDSVLLEDGDVINIPEKTSLVMVHGEVLFPNAVSWQKGMTTEDYIEKCGGLTQKSGNARIIVIRQNGAAVNAEDVDSLKPGDEIMVLPKYESKNIEVTRGISTILYQLAVGAKVILSL

SEQ ID NO: 7 - DNA, 738 bp, Artificial Sequence
  Synthetic Sequence
atgtcgaaggccgtgattgtgatcccggcacgctacggcagcagccgtctgccgggcaaaccgctgctggatatcgtcgggaaaccgatgatccagcacgtctacgaacgggccctgcaagtggcaggcgtggcagaggtgtgggtcgcaaccgacgacccgcgtgtggagcaggcagtccaggcgttcggcggcaaagcgatcatgacccgcaacgatcatgagagcggcaccgatcgcctggtggaagtcatgcataaggtggaggcggatatctatatcaacctgcaaggggatgagccgatgattcgcccgcgtgacgtcgaaaccctgctgcaaggtatgcgggacgacccggcgctgccggtggcgaccctgtgtcatgcgatcagcgcggcagaagccgccgaaccgtccaccgtcaaggtcgtggtgaacacgcggcaggacgccctgtatttctcccgctcccccattccgtacccgcgcaacgccgagaaggcgcgctacctgaagcacgtcgggatctacgcctatcggcgggatgtcctgcaaaattacagccagttgccggagtccatgcccgaacaggccgaatccctggagcaactgcggctgatgagcgcgggcattaacattcgcaccttcgaggtcgccgcgaccggtcccggcgtcgataccccggcgtgcttggagaaggtccgggccctgatggcgcaggagctcgcggagaacgca

SEQ ID NO: 8 - protein, 246 aa, Escherichia coli
MSKAVIVIPARYGSSRLPGKPLLDIVGKPMIQHVYERALQVAGVAEVWVATDDPRVEQAVQAFGGKAIMTRNDHESGTDRLVEVMHKVEADIYINLQGDEPMIRPRDVETLLQGMRDDPALPVATLCHAISAAEAAEPSTVKVVVNTRQDALYFSRSPIPYPRNAEKARYLKHVGIYAYRRDVLQNYSQLPESMPEQAESLEQLRLMSAGINIRTFEVAATGPGVDTPACLEKVRALMAQELAENA

SEQ ID NO: 9 - DNA, 2025 bp, Artificial Sequence
  Synthetic Sequence
atgattggcatttatagccccggcatttggcgtattccgcacctggaaaaattcctcgcccagccctgccaaaagctgtcgctgctgcgcccggtcccgcaggaagtggatgcaatcgcggtgtgggggcaccgcccctcggccgcaaagccggtggccatcgccaaagccgcaggcaagccggtgatccgcttggaggatggtttcgtccgctcgctggacctgggcgtgaacggtgaaccgcccctctcgctcgtcgtggatgactgcggcatttactacgacgcctcgaaaccgagcgcgctggaaaaactcgtgcaggacaaggccggcaacgcggccctggcggatcaggcgcgcgaggcgatgcacaccattgtgacgggcgacatgagcaagtacaacctggcaccggcgttcgtggcggatgaaagcgagcgcacgaacatcgtgctggtggtggaccagaccttcaatgacatgagcgtgacctacggcaacgcaggcccccatgagttcgccgcaatgctggaagcagcgatggcggaaaacccgcaggcagaaatctgggtcaaagtgcatcccgatgtcctggaagggaaaaagaccggctacttcgcggacttgcgtgccacccagcgcgtgcgcctgattgcggaaaacgtgtcgccgcagtccctgctgcgtcatgtgtcccgcgtgtacgtcgtgacctcccagtacggttttgaagccctgctggccggtaagcccgtgacctgctttggccaaccctggtatgcagggtggggcctcaccgatgaccgccacccccaatcggcgctgctgtcggcgcgtcgcggctcggccaccctggaggaactgttcgcagcggcctatctgcgctattgccgctacattgatccgcagaccggggaggtgtcggccctgttcacggtgctccaatggctccagctgcaacgtcgtcacctgcaacagcggaatggttatctctgggtgccgggcctgaccctgtggaaaagcgcgatcctgaagcccttcctgcaaacggccacgaatcgtctctccttttcccgtcgctgtaccgcagcaagcgcctgcgtcgtgtggggcgtgaaaggcgaacagcaatggcgtgcggaggcacagcgcaaatccctgccgctgtggcgcatggaagacggcttcctgcgcagctccggcctggggagcgatctgctgccgccgttgagcctggtcctggataagcgcggtatctattacgatgccacccgtccgtcggaactggaggtcctgctgaatcacagccagctgaccctcgcgcaccagatgcgcgcggaaaagttgcgccaacgtctggtggaaagcaaattgagcaaatataacctgggggccgatttcagcctcccggcagaagcgaaggacaagaaagtcatcctggtgccgggccaggtggaagacgatgcgtcgattaagacgggcaccgtgtcgatcaagtcgaatctggagctgctgcgcaccgtgcgggaacgtaatccgcacgcctacatcatctacaagccgcaccccgatgtgctcgtcggcaaccgtaagggtgacattccggcggaacagatcgcggaactcgcagactaccaggcactggatgccgatatcattcagtgtattcagcgtgcggacgaggtgcacacgatgacgagcctcagcggctttgaagcattgctgcacggtaaacaggtgcactgctacggcctgccgttctacgcctcgtggggcctgaccgtcgatgagcaccactgcccccgtcgcgagcggcggctgaccatcgccgacctgatctatcaagccctgattgtctatcccacctatattcatccgacgcggttgcagccgatcacggtggaggaagcggcagaatatctgatcaaaacgccccgcaaacccatctttatcacccgcaagaaagccggccgtgtgattcgctactatcgcaagttgatcatgttctgcaaagtgcgctttggt

SEQ ID NO: 10 - protein, 675 aa, Escherichia coli
MIGIYSPGIWRIPHLEKFLAQPCQKLSLLRPVPQEVDAIAVWGHRPSAAKPVAIAKAAGKPVIRLEDGFVRSLDLGVNGEPPLSLVVDDCGIYYDASKPSALEKLVQDKAGNAALADQAREAMHTIVTGDMSKYNLAPAFVADESERTNIVLVVDQTFNDMSVTYGNAGPHEFAAMLEAAMAENPQAEIWVKVHPDVLEGKKTGYFADLRATQRVRLIAENVSPQSLLRHVSRVYVVTSQYGFEALLAGKPVTCFGQPWYAGWGLTDDRHPQSALLSARRGSATLEELFAAAYLRYCRYIDPQTGEVSALFTVLQWLQLQRRHLQQRNGYLWVPGLTLWKSAILKPFLQTATNRLSFSRRCTAASACVVWGVKGEQQWRAEAQRKSLPLWRMEDGFLRSSGLGSDLLPPLSLVLDKRGIYYDATRPSELEVLLNHSQLTLAHQMRAEKLRQRLVESKLSKYNLGADFSLPAEAKDKKVILVPGQVEDDASIKTGTVSIKSNLELLRTVRERNPHAYIIYKPHPDVLVGNRKGDIPAEQIAELADYQALDADIIQCIQRADEVHTMTSLSGFEALLHGKQVHCYGLPFYASWGLTVDEHHCPRRERRLTIADLIYQALIVYPTYIHPTRLQPITVEEAAEYLIKTPRKPIFITRKKAGRVIRYYRKLIMFCKVRFG

SEQ ID NO: 11 - DNA, 1209 bp, Artificial Sequence
  Synthetic Sequence
atgcacggcaatgcgctgacggtgctgttgagcggtaaaaagtacctcctgctccaaggtccgatgggtccgttcttcaacgatgtggcggaatggttggagagcctcggtcgcaacgcggtcaacgtcgtctttaatggcggtgatcgcttctactgccgccaccgccaatacctggcgtactaccaaaccccgaaggagttccccggttggctgcgggacttgcatcgtcagtatgactttgacacgattttgtgtttcggtgactgccgcctgctgcacaaggaggccaaacgctgggccaagtcgaaggggattcgttttctggccttcgaggaaggctacctgcgtccgcaatttatcaccgtggaagaaggcggtgtgaacgcctatagcagcttgccccgcgatccggacttttaccgcaaattgcccgatatgccgacgccgcacgtcgagaacctgaaaccgagcaccatgaagcgcatcggccacgccatgtggtattacctgatgggttggcactatcgtcacgaatttccgcgctatcgccaccacaaatcgttcagcccgtggtatgaagcgcgctgctgggtccgcgcctactggcgcaaacagctgtataaggtcacccaacgcaaggtcctcccccgcctgatgaacgagctggatcagcgctattacctggcggtcctgcaagtgtacaacgacagccagatccgcaaccatagcaactataatgatgtgcgtgattacatcaacgaagtgatgtacagcttttcccgcaaggcccccaaggagtcctatctggtgatcaaacatcacccgatggatcgcgggcaccgcctgtaccgcccgttgatcaagcgtctgtcgaaggaatacggtttggatgaacgtgtcatctatgtgcacgatctgcccatgccggagctgttgcgccacgccaaagcggtggtcaccatcaatagcacggccggcatttccgcgttgatccacaacaagcccctgaaagtcatgggcaacgccttgtacgatatcaagggtctgacgtaccaggggcatttgcatcagttctggcaagccgactttaaaccgaacatgaagttgtttaagaaatttcgcggctacttgctggtgaagacccaggtcaatgcggtgtactacggcgaaatgatctttaacaaaattaagaagtataagaaacgt

SEQ ID NO: 12 - protein, 403 aa, Escherichia coli
MHGNALTVLLSGKKYLLLQGPMGPFFNDVAEWLESLGRNAVNVVFNGGDRFYCRHRQYLAYYQTPKEFPGWLRDLHRQYDFDTILCFGDCRLLHKEAKRWAKSKGIRFLAFEEGYLRPQFITVEEGGVNAYSSLPRDPDFYRKLPDMPTPHVENLKPSTMKRIGHAMWYYLMGWHYRHEFPRYRHHKSFSPWYEARCWVRAYWRKQLYKVTQRKVLPRLMNELDQRYYLAVLQVYNDSQIRNHSNYNDVRDYINEVMYSFSRKAPKESYLVIKHHPMDRGHRLYRPLIKRLSKEYGLDERVIYVHDLPMPELLRHAKAVVTINSTAGISALIHNKPLKVMGNALYDIKGLTYQGHLHQFWQADFKPNMKLFKKFRGYLLVKTQVNAVYYGEMIFNKIKKYKKR

SEQ ID NO: 13 - DNA, 774 bp, Artificial Sequence
  Synthetic Sequence
atggcacgttcgggttttgaagtccagaaagtgacggtcgaagcactgtttctccgcgaaatccgtacgcgctttggcaagtttcgcctgggctatctgtgggcgatcctggaaccgagcgcacatctgctgattctgctcgggatctttggctatatcatgcatcgcaccatgccggatatctccttcccggtgttcctgctcaatggcctgatcccgttctttattttcagcagcatcagcaatcgctccgtgggcgccatcgaagccaatcaggggctgtttaactaccggcccgtgaagccgatcgacacgatcattgcacgcgccctcttggaaacgctgatctatgtggcggtctacatcctcctgatgctgatcatctggatggcgggcgaatatttcgagattaccaacttcctgcaatttgtgctcacctggagcctcctgatcatcctgtcgtgcggtgtgggcctgatcttcatggtcgtgggcaagacgttccccgaaatgcagaaagtcttgccgatcttgctgaagccgctgtactttatttcgtgcatcatgttcccgctgcactccattccgaagcagtattggtcgtacctgctgtggaatcccctggtgcacgtcgtcgaactgagccgcgaggccgtgatgcccggttatatcagcgaaggggtcagcctgaattatctggcaatgttcaccctggtgaccctgtttattggtttggccctgtaccgtacgcgtgaggaggcaatgttgacctca

SEQ ID NO: 14 - protein, 258 aa, Escherichia coli
MARSGFEVQKVTVEALFLREIRTRFGKFRLGYLWAILEPSAHLLILLGIFGYIMHRTMPDISFPVFLLNGLIPFFIFSSISNRSVGAIEANQGLFNYRPVKPIDTIIARALLETLIYVAVYILLMLIIWMAGEYFEITNFLQFVLTWSLLIILSCGVGLIFMVVGKTFPEMQKVLPILLKPLYFISCIMFPLHSIPKQYWSYLLWNPLVHVVELSREAVMPGYISEGVSLNYLAMFTLVTLFIGLALYRTREEAMLTS

SEQ ID NO: 15 - DNA, 666 bp, Artificial Sequence
  Synthetic Sequence
atgattaagatcgaaaacctgacgaaaagctaccgcaccccggtgggccgtcactatgtcttcaagaacctgaacattgagatccccagcggcaaaagcgtggcgttcatcgggcgcaatggggcgggtaaatccacgctgttgcgcatgattgggggcatcgaccgcccggatagcggtaaaatcatcacgaataaaacgatctcgtggccggtgggtctggcaggcggcttccagggcagcttgaccgggcgtgaaaacgtgaagttcgtggcccggctgtacgcgaagcaggaggagctgaaagaaaagattgagtttgtggaagagttcgcggagctggggaagtattttgatatgccgatcaagacctattcgagcggtatgcgcagccgcctcggcttcggcctgagcatggcgttcaagttcgattactacatcgtggacgaggtgacggcggtgggggacgcccgtttcaaggaaaaatgtgcccaactcttcaaggagcgtcataaggaaagctccttcctcatggtgtcgcactcgctgaactcgttgaaagagttctgcgatgtggcaatcgtgtttaaagacgacaacgccgtgtcgttccatgaagacgtgcaagaaggcattgaagaatatatcaccgaacaaaacaactac

SEQ ID NO: 16 - protein, 222 aa, Escherichia coli
MIKIENLTKSYRTPVGRHYVFKNLNIEIPSGKSVAFIGRNGAGKSTLLRMIGGIDRPDSGKIITNKTISWPVGLAGGFQGSLTGRENVKFVARLYAKQEELKEKIEFVEEFAELGKYFDMPIKTYSSGMRSRLGFGLSMAFKFDYYIVDEVTAVGDARFKEKCAQLFKERHKESSFLMVSHSLNSLKEFCDVAIVFKDDNAVSFHEDVQEGIEEYITEQNNY

SEQ ID NO: 17 - DNA, 1017 bp, Artificial Sequence
  Synthetic Sequence
atgaacatcctggtcaccggcggtgcaggctacatcggcagccacacgtcgctctgcctgctgaacaaaggctacaatgtcgtcatcattgacaatctcatcaacagcagctgcgaaagcatccgtcgcattgagctgatcgcaaagaagaaagtcacgttctacgaactcaatatcaacaacgagaaggaagtgaaccagatcctgaagaaacacaaattcgactgcatcatgcactttgcaggtgcgaaatcggtcgcagaaagcctgatcaagcccatcttctactatgacaacaacgtgagcggcaccctgcaactcatcaattgcgccatcaagaacgacgtcgccaacttcatctttagctcgtcggcgacggtgtatggggaaagcaagatcatgcccgtcaccgaagactgccatattggtggcacgctgaatccgtatggtacgtccaagtacatctcggagctgatgatccgcgacatcgccaagaaatactccgacacgaatttcctctgcttgcgctactttaatccgacgggcgcccacgaatccggtatgattggtgaaagcccggcagacatcccctccaacttggtgccgtacatcttgcaggtcgcgatggggaaactggaaaaactgatggtgttcggtggtgattatcccaccaaagacggcacgggggtccgtgactatatccatgtgatggacctggccgaagggcacgtcgcagcgctgtcctatctcttccgcgacaataacaccaactaccacgtctttaatttgggcacgggtaaaggttattcggtgctggaactggtgtccacctttgaaaagatttccggcgtgcggattccgtatgaaatcgtgagccgccgtgacggtgatatcgcggagagctggtcctcccccgaaaaggccaacaaatatctgaactggaaagccaagcgggaactcgaaaccatgctggaggacgcctggcgctggcagatgaagaatccgaatggctatatt

SEQ ID NO: 18 - protein, 339 aa, Escherichia coli
MNILVTGGAGYIGSHTSLCLLNKGYNVVIIDNLINSSCESIRRIELIAKKKVTFYELNINNEKEVNQILKKHKFDCIMHFAGAKSVAESLIKPIFYYDNNVSGTLQLINCAIKNDVANFIFSSSATVYGESKIMPVTEDCHIGGTLNPYGTSKYISELMIRDIAKKYSDTNFLCLRYFNPTGAHESGMIGESPADIPSNLVPYILQVAMGKLEKLMVFGGDYPTKDGTGVRDYIHVMDLAEGHVAALSYLFRDNNTNYHVFNLGTGKGYSVLELVSTFEKISGVRIPYEIVSRRDGDIAESWSSPEKANKYLNWKAKRELETMLEDAWRWQMKNPNGYI

SEQ ID NO: 19 - DNA, 1638 bp, Artificial Sequence
  Synthetic Sequence
atgaaccgcctggtgatcgtgggccatccgagcagcaactaccaaatcgtggaagaactcctgcatcagcgcggcatgaactccctgtgcccgtccaaacgtgagaacctctcgccccaggacatcacccagacgctgcggaaggcgtaccagtcgccggacatctatacggtgaccgattccgccgactttgaaccgctccatgtgagcaccgtctggaacggtatcgcattggatctgatgctgtccaacctgaaccagaaactgtgcggttggagcgaccccaacgcaattcacacgttggaatattggaaatcggtggatgagaacatcacctttatcctcatctacgaccaccccaaaagcatcctgacgaactacttctcggaccagaacatctccagcaactatacctcggagcatctgatcaaaaactggctggcatacaacaccgccttgctgcacttcttcctcaacaaccggggtcggtgcctgctggtgtcgagcgaacaggtgaagcgcaacgccgaggactgcatccagcaactgcaacacaaactgaaactgaaattcgggttgtcgttctccaataccatcaaccactcgctggagcagagcgtgaatgactttaagaccgccgaagcctccattacgctggaaaaagaacatcaggagatcatgtccctcagcggtattgacatcgggaccggggatatcattttcaagcaaagcgagacggaggagtacttgatcttcaacgtcctgaacgactatcccgattgcaaggaactgtactttgaattgcaatcgaacgccaacacccccttgcgggtgctggagaaggaaaactataagccgtcctttatttgggagacgttcattaaacaacgccagatcaccctcgatatcgtgaacggtctgtaccagagcagcaaaaagatcattctggacaacgaactgcacacgtccaaacagctgaacgcctatcaagccattctgaaagagctgtcggatagcaaggaagaactgatccagtatgatctgatcattaaaaacaaaaccatccaggtccaggaactggagtgcgcgatcgagaacttcgagtccctgctgaaaaaggaacagaacaaaaatgaactgcaacaacagcgcctcgaaaagctgtcgtgcgaaaaagaattgctgctcaatcagctgcatctggtgcagcaaaagctcgaacagtacttcatcgacaatcaacgtctcgaaaagaaacaactgccggagctgtatggtgcggccgaacgcatcaagcaagatatcggctaccgcctgggtgcggtgatggtgagccgctccaagacgttcctcggtctgatctcgattccgtttgcgttgatcagcgaatggcggacctggaagaagaaatatgattcggagtaccaagtgagcctgccgagcatcttcctgtacgcggataaacacgaagccgaacgggtcaagaaacacctgagctatcagctgggcaagctcatcatcaataagaacaattttccgctcggtctgatcagcctgccctttagcatctaccgtaccatccgccaattcaaacgcaccaaaaacaattcccaggtgggtgtcaagtactgcggtaag

SEQ ID NO: 20 - protein, 546 aa, Escherichia coli
MNRLVIVGHPSSNYQIVEELLHQRGMNSLCPSKRENLSPQDITQTLRKAYQSPDIYTVTDSADFEPLHVSTVWNGIALDLMLSNLNQKLCGWSDPNAIHTLEYWKSVDENITFILIYDHPKSILTNYFSDQNISSNYTSEHLIKNWLAYNTALLHFFLNNRGRCLLVSSEQVKRNAEDCIQQLQHKLKLKFGLSFSNTINHSLEQSVNDFKTAEASITLEKEHQEIMSLSGIDIGTGDIIFKQSETEEYLIFNVLNDYPDCKELYFELQSNANTPLRVLEKENYKPSFIWETFIKQRQITLDIVNGLYQSSKKIILDNELHTSKQLNAYQAILKELSDSKEELIQYDLIIKNKTIQVQELECAIENFESLLKKEQNKNELQQQRLEKLSCEKELLLNQLHLVQQKLEQYFIDNQRLEKKQLPELYGAAERIKQDIGYRLGAVMVSRSKTFLGLISIPFALISEWRTWKKKYDSEYQVSLPSIFLYADKHEAERVKKHLSYQLGKLIINKNNFPLGLISLPFSIYRTIRQFKRTKNNSQVGVKYCGK

SEQ ID NO: 21 - DNA, 2058 bp, Artificial Sequence
  Synthetic Sequence
atgagcattttgaaccaggcaatcaatctgtataagaataagaactaccgccaagccctctccctgtttgaaaaagtggcggaaatctatgatgtgagctgggtggaagccaatatcaagctgtgccaaaccgccctgaatctgagcgaagaagtggacaagctgaatcggaaagcggtcattgatatcgacgcggcaaccaaaattatgtgcagcaatgcaaaggcgatctcgctgaatgaggtggaaaagaatgaaatcattagcaaatatcgggaaattaccgcaaagaaatccgagcgcgccgaattgaaagaagtcgaacccattccgctggattggccgagcgacctgaccttgccgccgctgccggaaagcacgaacgactacgtctgggcagggaaacgtaaagaactggatgattatccgcgcaagcaactgatcatcgacggcctgtccatcgtgattccgacgtacaatcgcgccaaaatcctggcgatcaccctggcctgcctctgcaatcagaaaacgatttatgactatgaggtcatcgtcgcggatgacggttccaaggaaaacatcgaagagatcgtccgcgagttcgagtcgttgctgaacatcaaatacgtccgccagaaagactacggctaccagctgtgcgccgtgcggaacctgggcctgcgggcagcgaaatacaactacgtggcgatcttggactgcgatatggcgccgaacccgttgtgggtgcagtcctatatggaactcctggccgtggatgataacgtggcactgattggcccgcgtaaatacatcgacacgtcgaagcatacctatctggactttttgtcccagaaaagcctgatcaatgaaatcccggagattattaccaataatcaggtcgcaggcaaggtcgagcagaacaaatccgtcgattggcgcatcgaacatttcaagaataccgacaatctgcgcctgtgcaacaccccgttccggttctttagcggtggcaatgtggcgtttgcaaagaagtggctgtttcgcgcgggttggtttgacgaagagttcacgcattggggcggtgaggataatgagttcggctatcggctgtaccgcgagggttgttatttccgtagcgtggaaggcgcgatggcatatcatcaggaaccgcccggtaaggagaacgaaaccgatcgcgcggcaggtaaaaacattaccgtccagctgttgcagcagaaggtgccctacttttatcgcaagaaggagaaaatcgagagcgccaccctgaaacgtgtgcccctggtgagcatctacatccccgcgtataattgcagcaaatatatcgtgcgctgcgtcgaatcggcactgaaccaaacgatcaccgatctggaggtctgcatctgcgatgacgggagcaccgatgatacgctgcgcatcctgcaagaacattacgcaaaccacccgcgcgtccgtttcatcagccagaaaaacaaaggcatcggctccgcctcgaataccgcagtccgcctgtgccggggtttctacatcgggcagctggattccgatgatttcctggagcccgatgccgtggaactgtgtctggatgaatttcgcaaagacctgagcctcgcctgcgtgtacaccaccaatcgcaatattgatcgtgaaggtaacttgattagcaatggctacaactggccgatttacagccgcgaaaagctcacgagcgcgatgatctgccaccacttccgtatgttcacggcgcgtgcatggaacctcaccgaaggcttcaacgagagcatcagcaatgcggtggattacgatatgtatttgaaactcagcgaagtcggcccgtttaagcatatcaataagatttgctacaaccgtgtcctgcacggcgagaacacgtcgatcaagaaactggacatccaaaaggaaaaccatttcaaggtggtgaacgaaagcctgtcgcgcctcggtatcaaaaagtacaaatactcgccgctgaccaacttgaatgaatgtcgcaaatatacctgggagaagatcgaaaacgacttg

SEQ ID NO: 22 - protein, 686 aa, Escherichia coli
MSILNQAINLYKNKNYRQALSLFEKVAEIYDVSWVEANIKLCQTALNLSEEVDKLNRKAVIDIDAATKIMCSNAKAISLNEVEKNEIISKYREITAKKSERAELKEVEPIPLDWPSDLTLPPLPESTNDYVWAGKRKELDDYPRKQLIIDGLSIVIPTYNRAKILAITLACLCNQKTIYDYEVIVADDGSKENIEEIVREFESLLNIKYVRQKDYGYQLCAVRNLGLRAAKYNYVAILDCDMAPNPLWVQSYMELLAVDDNVALIGPRKYIDTSKHTYLDFLSQKSLINEIPEIITNNQVAGKVEQNKSVDWRIEHFKNTDNLRLCNTPFRFFSGGNVAFAKKWLFRAGWFDEEFTHWGGEDNEFGYRLYREGCYFRSVEGAMAYHQEPPGKENETDRAAGKNITVQLLQQKVPYFYRKKEKIESATLKRVPLVSIYIPAYNCSKYIVRCVESALNQTITDLEVCICDDGSTDDTLRILQEHYANHPRVRFISQKNKGIGSASNTAVRLCRGFYIGQLDSDDFLEPDAVELCLDEFRKDLSLACVYTTNRNIDREGNLISNGYNWPIYSREKLTSAMICHHFRMFTARAWNLTEGFNESISNAVDYDMYLKLSEVGPFKHINKICYNRVLHGENTSIKKLDIQKENHFKVVNESLSRLGIKKYKYSPLTNLNECRKYTWEKIENDL

SEQ ID NO: 23 - DNA, 1431 bp, Artificial Sequence
  Synthetic Sequence
atgttgaagaacttgaccttcgatcacatcctgagcctgagcaagaaagaagataaaatcaaactggtgcagctcatcgtcaaccatctggacgagcgcacgctgtcctgcatcaagaacatttcgaccggcaaaggctttaatgcgcatctcaaaatcctggagttgttcgacttgtggctgtcggaatacttcgagtatattatcatcccgaacaagttgtcgaacgcagggacgttttacttcgcgttcttctttccggagttctacatcaaacgtttcaacaagaataacacggacctgtccagcttgggtgataccagcttcaagcgcctgatgagccgtccgcacatccccaactacgtgtataatctcgtgatcaactcgaacggctgcaccttcaattcgattaagttgttgctgctcgcactgtccctgaccagcaaacgcttctacgaaaccccgcagcaggagcgcaacttcttgtgccacatcaatgaaattgtcctggcaaacgccgacgaatatagcggcatcatttcctgtatcatcaaatcgcgcatctcggtgattgatgatttcattagcagcaatgtgagcctgaataccaatcgccagatcgcattgttcatcacggggcagtcgcgcggtttcatcgacgcgctgccgaacctggtcagcaagatcacgattccgtcggacgtcgatgtgtttatctccacctggaaggatatcgggcatacgcaactgagcaaagaacgcatctgccgcatttttgattcggaagccgcccaatacgtgtccgaacccgacaattacagcttcgtggatgaacattatgatgagctgaaagacctgtcgctctcctcctataagaacaataacctggaagaaatctactcgtcgttcttctccggctgcaactccgtcctgatcaatatcaaggatgatggcgaatatccgtataacaagatgagcaacgcggaaaagatgtactaccacaattccttttggttctgctcgctgaaaaatcataactgggataagtaccgctgcatcatcaaaatccgccccgatgccctgctgcaagtggataacgtgaccatcaacgatatcgacgtggacgacagcgtgtattgcgaggacagcaacggttggatttttcgcgagtgggggtttggcatcggcgatcagctgttctatggcgacccggacatcatgaagaaactgatgtgcgtgcatggtctggataacatttactcgcaactgacgagcctgatctcgtcgtcgaatgtgtactactcggggcacatcaacgtcggcttgtgcgcctgggccaatgtgtacgactgtaaagtgagcaatctgaagatcaagaatattgtggccccgcgtaaaatcagcctggagcaaattctgagcctgcgggaa

SEQ ID NO: 24 - protein, 477 aa, Escherichia coli
MLKNLTFDHILSLSKKEDKIKLVQLIVNHLDERTLSCIKNISTGKGFNAHLKILELFDLWLSEYFEYIIIPNKLSNAGTFYFAFFFPEFYIKRFNKNNTDLSSLGDTSFKRLMSRPHIPNYVYNLVINSNGCTFNSIKLLLLALSLTSKRFYETPQQERNFLCHINEIVLANADEYSGIISCIIKSRISVIDDFISSNVSLNTNRQIALFITGQSRGFIDALPNLVSKITIPSDVDVFISTWKDIGHTQLSKERICRIFDSEAAQYVSEPDNYSFVDEHYDELKDLSLSSYKNNNLEEIYSSFFSGCNSVLINIKDDGEYPYNKMSNAEKMYYHNSFWFCSLKNHNWDKYRCIIKIRPDALLQVDNVTINDIDVDDSVYCEDSNGWIFREWGFGIGDQLFYGDPDIMKKLMCVHGLDNIYSQLTSLISSSNVYYSGHINVGLCAWANVYDCKVSNLKIKNIVAPRKISLEQILSLRE

SEQ ID NO: 25 - DNA, 1566 bp, Artificial Sequence
  Synthetic Sequence
atgcttctaataatgtctggtagctacgtgcagcaggaattgggcgcggagttcggtagcatcccgccgtcgttcctgccgttggcaaacaagcgtctgttcaagcaccaggtcagcttggggcacgatggccatgcgatctacctggtcctgccggaagatttcgtgttcgacaaacacgattacgaatggttgctgcgcaataaagtgacgatgattccggtcgatagcaatctgaccctgggccaggcaatcgtcacggcctggaatctgatcggcgacaaagatgataaaggcctgcaactgctgtttggtgataccttgttcaagaagattccggcgggtgatgacctcgtggcgatctcccattccgatgataactaccagtggtcctttttctatgagacggaattgcgggcagtctcccgcgaggacaacaaaaatgtcatctgcgggtacttctcgttcagcaaacccaatttcttcattcgcgaactggtcaccagcaagtttgacttcacggcagccctgaaaaagtaccatgattcgtacagcttggcgtcgatttacgtcagcgactggctcgatttcggtcacatcaatacctactataagtcgaaagtccagtacacgacccagcgtgccttcaatgagctgtgcatcacgaccaagtccgtgattaagtcctcctcgaatgaaagcaagatcgaggcagaatcgaaatggttcgagacgattccgggtgaactgaaaatctacaccccgatgttgctggaaccgttcgatcacattcgcaaaagctacaaactcgaatacctgtacaataccaccctgaacgaactgttcgtgttctcccgcctgccgaataatatcctgaccaacattctgatcagctgcctggattttatcgacctctgcaaagagtatcatagcattgatacggataaaaacattctccaggatctgttttacgaaaagaccatcgagcgcgtcagcaagtatatcaccgatctcaacattgacccgaacgcgaaatggaattttaacaacaatattagcgtgagcatcaacgacatcctgtacgacacgaacaaattcattccgtccgaactgcaatacaagaccatcatgcacggggacctgtgcttcagcaatattatctttaacttccgcacgggccggattcaggtgttcgatccgcgcggtctgaaccacagcggcgaaatctcgatctatggcgatttccgctacgatattgcgaaactgtcgcactccattctaggcctgtatgactggatcatcgcgggctactacattatcaacaaaaagaataagacccattccattgagttcaaaatcaatattgataacaaactctttgaaatccaatcgaccttcgtgtccattattaaggaaaaatacagcatctccgaaaagtcgctgtacgccatgcaaattcatctgttcttgtcgatgctgccgttgcatagcgacgacaagaagcggcaggacgccctgtttgcgaatgccttccgcctgtatgaaatctttaaggaggcagcagta

SEQ ID NO: 26 - protein, 522 aa, Escherichia coli
MLLIMSGSYVQQELGAEFGSIPPSFLPLANKRLFKHQVSLGHDGHAIYLVLPEDFVFDKHDYEWLLRNKVTMIPVDSNLTLGQAIVTAWNLIGDKDDKGLQLLFGDTLFKKIPAGDDLVAISHSDDNYQWSFFYETELRAVSREDNKNVICGYFSFSKPNFFIRELVTSKFDFTAALKKYHDSYSLASIYVSDWLDFGHINTYYKSKVQYTTQRAFNELCITTKSVIKSSSNESKIEAESKWFETIPGELKIYTPMLLEPFDHIRKSYKLEYLYNTTLNELFVFSRLPNNILTNILISCLDFIDLCKEYHSIDTDKNILQDLFYEKTIERVSKYITDLNIDPNAKWNFNNNISVSINDILYDTNKFIPSELQYKTIMHGDLCFSNIIFNFRTGRIQVFDPRGLNHSGEISIYGDFRYDIAKLSHSILGLYDWIIAGYYIINKKNKTHSIEFKINIDNKLFEIQSTFVSIIKEKYSISEKSLYAMQIHLFLSMLPLHSDDKKRQDALFANAFRLYEIFKEAAV

SEQ ID NO: 27 - DNA, 1167 bp, Artificial Sequence
  Synthetic Sequence
atgaaaattgccgtggccggcgtcggctatgtgggtatcagcattgcgatcctcctctcccaaaaacacgacatcatcgccctggacatcgacccgaagaaggtccagctcattaacaagaaaatctcgccgatttgcgacccggaaatccagaagtttctctccaatcgtaagctgaacctctacgcgacgacggaaaaatacgaggcatatcgcgatgcagactacgtgatcatcgccaccccgacgaactatgatccgattaataacaactttgataccctgagcgtcgaaagcgtcgcgtgtgacgtgctgtccattaacccgaacgcgaccatcattatcaaatccaccgtccccgtcgggttcaccgaacgcctgaagcgcgatctgaacacgaataatatcatcttttccccggagttcctgcgcgaaggcaaagccctgtatgataatctctatccgagccgcattgtcgtgggcgaatcgtcggaacgcgcacggaagttcgccgaactcctgtcggaaggtgccatcaaaaaggatattccgatcctgctgacggattcgcccgaggcagaagccatcaaactgttcgcgaacacgtatctggcgatgcgtatcgcgtactttaacgagctggacacctacgcgagcgtgcacggcctggataccaaacaaatcatcgaaggcgtctccctcgatccgcgcattggtcaacattacaacaacccgtccttcggctacggcggttactgtctgccgaaggatacgaagcagctgttggccaattatcgcgacgtcccgcaaaacctgatccaggccatcgtggatgcgaatacgacccgtaaggacttcgtggccgaggacatcctgtcccgtaagcccaaagtggtcggtatctatcgcctgatcatgaaggcgggtagcgacaatttccgggccagcagcatccagggggtcatgaaacgtttgaaggccaagggtatcgagattgtggtgtacgagccggtcctgaaagaaccctacttcttcggttcctacgtcgagcgcgacatcaattcctttaaggagcgcgtcgatgtcattgtggcgaatcgccgcaccagcgaactggaagatgtctcggagaaagtctacacccgcgacctgttcggcgtcgattcg

SEQ ID NO: 28 - protein, 389 aa, Escherichia coli
MKIAVAGVGYVGISIAILLSQKHDIIALDIDPKKVQLINKKISPICDPEIQKFLSNRKLNLYATTEKYEAYRDADYVIIATPTNYDPINNNFDTLSVESVACDVLSINPNATIIIKSTVPVGFTERLKRDLNTNNIIFSPEFLREGKALYDNLYPSRIVVGESSERARKFAELLSEGAIKKDIPILLTDSPEAEAIKLFANTYLAMRIAYFNELDTYASVHGLDTKQIIEGVSLDPRIGQHYNNPSFGYGGYCLPKDTKQLLANYRDVPQNLIQAIVDANTTRKDFVAEDILSRKPKVVGIYRLIMKAGSDNFRASSIQGVMKRLKAKGIEIVVYEPVLKEPYFFGSYVERDINSFKERVDVIVANRRTSELEDVSEKVYTRDLFGVDS

SEQ ID NO: 29 - DNA, 1464 bp, Artificial Sequence
  Synthetic Sequence
atgttcaataatctcaaattcttgtggctgctcaaaaagagccgctacgtccacgcgctcgcggccatccaggatgattgccggttctggcagtcgaaacgcatcctcgcgatgtatcgtctgaatatgtactggtcgctgcataacttgacggataccccgtccgattggcgctgcaaactggcaatcaagatcgcaaaaatcgcctgcggcgacatcagcctgacgcccgagctgctgatggagttcaaggacgagttcaccgatacccatcagaaagtggaactggcgaaaaccctggcgtcctactcgccgacctttagcctgagcctgttggacaacgtggacaactgcccgctggacctgtataccgcactgcaactccggatcggcctgacccaaaaggccatctcgaccctcgcccagatcgacgcatccgatatcgtctatagcccggatatcctgctgctgcaaaataacgccttccgcgaaaccgccgaaattagcctgaatcggctgaatgaatactataaatacttcggcctcagccccgtggccttgacggacaacagctccccgctctccccgtgcaacatcatcaccagcatcccgtacccggcccagacggggccgttgatctccatcctgatgaccacctataatacgggtcgccgcgtggaaaatgcggtgatttcgctcctcaatcagacctaccgttccttcgagctgatcattgtggatgacgcgagcaccgatgacaccctgtttcgtctccagcggctcgccctcaaagacacgcgcatcaagatcattagcctgccgcagaatgtcggcacctatgccgcgaagcgtatcggcttgatccaagcgaagggcgagttcgtcacctgccacgattcggatgactggagccatccggaaaagctgttccgccaaatctcccccttgttgctcaatccgaagctcatctgctccatctcggactgggtgcgcctgcaagacaacggtattttctatgcccgcgcagtgtaccccttgaagcgtctgaatccgtcgtcgctcctgtttcgccgtgccgacgtcttgcagaaggccggtgtctgggattgtgtgaaaacgggtgcggatagcgaatttatcgcgcgtctgaagctgatcttcggcgattccacggtgcatcggatcaagttgccgctgacgctgggctcgcaccgcaccgactcgttgatgaacagcccgacgaccggctacaccagccaaggtatctcgccggatcgccagaagtattgggattcgtggtcccgctggcacatccaggcgctgcgtaacaaggaatcgctgtacattggtaacagcgatttcaccaacaagaaccgtccgttttccgcacccgactcgatcctcgtggacaccaacgccattaagacggccctgcaaagcgcccacgtcaatttcacgagcatc

SEQ ID NO: 30 - protein, 488 aa, Escherichia coli
MFNNLKFLWLLKKSRYVHALAAIQDDCRFWQSKRILAMYRLNMYWSLHNLTDTPSDWRCKLAIKIAKIACGDISLTPELLMEFKDEFTDTHQKVELAKTLASYSPTFSLSLLDNVDNCPLDLYTALQLRIGLTQKAISTLAQIDASDIVYSPDILLLQNNAFRETAEISLNRLNEYYKYFGLSPVALTDNSSPLSPCNIITSIPYPAQTGPLISILMTTYNTGRRVENAVISLLNQTYRSFELIIVDDASTDDTLFRLQRLALKDTRIKIISLPQNVGTYAAKRIGLIQAKGEFVTCHDSDDWSHPEKLFRQISPLLLNPKLICSISDWVRLQDNGIFYARAVYPLKRLNPSSLLFRRADVLQKAGVWDCVKTGADSEFIARLKLIFGDSTVHRIKLPLTLGSHRTDSLMNSPTTGYTSQGISPDRQKYWDSWSRWHIQALRNKESLYIGNSDFTNKNRPFSAPDSILVDTNAIKTALQSAHVNFTSI

SEQ ID NO: 31 - DNA, 723 bp, Artificial Sequence
  Synthetic Sequence
atgattattatcccgatggcaggtatgtcgagccgctttttcaaagccggttatagcaaaccgaagtatatgctggagctgaatggcgagtttctgttcgatttgtgcctcaagagcttcaaactgtacttcgagacggaacactttgtcttcatcctccgtgacgtgtttaacacgaaatcgttcgtgctccagcgtatcgccagcctgggcattaatagctatacgctgatcaccctggataaggaaacgcggggtcaagcagagacggtctatttggccatctcgaaactgtttaatatcgaacagccgatcaccatcttcaacatcgacacgattcgtcccaacttcatcttcaccaagttcgagggcgagaatgaatgttacattgaagtgtttcgcggcgatggcgacaactggtcgttcgtgatgcccagcaatgacgtcaaaaatgaagtgattgccacgtccgaaaagaaacagattagcaatttgtgttgcaccgggctgtaccacttcagcacgatcaaaaactttatttccgcgtatgaacattacaagaacctgccgcaagaaaactgggatgcgggcgagctgtatattgcgccgatctacaattacctgatctccaatgggatcaaagtgtattataccgaaatcaataagtccgacgtgatcttctgcggcaccccgcgtgagtatgagaatctccaggggaaaaag

SEQ ID NO: 32 - protein, 241 aa, Escherichia coli
MIIIPMAGMSSRFFKAGYSKPKYMLELNGEFLFDLCLKSFKLYFETEHFVFILRDVFNTKSFVLQRIASLGINSYTLITLDKETRGQAETVYLAISKLFNIEQPITIFNIDTIRPNFIFTKFEGENECYIEVFRGDGDNWSFVMPSNDVKNEVIATSEKKQISNLCCTGLYHFSTIKNFISAYEHYKNLPQENWDAGELYIAPIYNYLISNGIKVYYTEINKSDVIFCGTPREYENLQGKK

SEQ ID NO: 33 - DNA, 378 bp, Artificial Sequence
  Synthetic Sequence
atgaagaaaattatcgtcgatctggataatacgattagcttcaatctgagcggcaaatacagccatgcaacccccaataagaaattgatcgaaaaactctatgagtacaagctgaacggtttctacatcgtcatctttaccgcgcgcaatatgcggacgtacaaggaaaacattggcaagatcaatattcatacgctgccggtgatcatcgactggctgaacgaaaaccgcgtcccgtatgacgaggtgattgtcggcaagccgtggtgcggcgacgagggcttctatgtggacgatcgggccatccggccctcggaactgtgcaatatgaccttggaagaaatctctaatatgttagaacaggagaaaaaatgcttc

SEQ ID NO: 34 - protein, 126 aa, Escherichia coli
MKKIIVDLDNTISFNLSGKYSHATPNKKLIEKLYEYKLNGFYIVIFTARNMRTYKENIGKINIHTLPVIIDWLNENRVPYDEVIVGKPWCGDEGFYVDDRAIRPSELCNMTLEEISNMLEQEKKCF

SEQ ID NO: 35 - DNA, 24433 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 36 - DNA, 24434 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 37 - DNA, 22773 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 38 - DNA, 22947 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatccgataaatcgattgatagatttaaataagaactgcagaagctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 39 - DNA, 22774 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 40 - DNA, 22948 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 41 - DNA, 24509 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaatgtttctgttgcataaagcctaaggggtaggcctttctagagatagccattttttgcactcctgtatccgcttcttgcaaggctggacttatccctatcaaaccggacactgcatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 42 - DNA, 14996 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 43 - DNA, 13336 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 44 - DNA, 22388 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 45 - DNA, 23738 bp, Artificial Sequence
  Synthetic Sequence
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 46 - DNA, 16 bp, Artificial Sequence
  Synthetic Sequence
aggaggttaataaatg

SEQ ID NO: 47 - DNA, 9089 bp, Artificial Sequence
  Synthetic Sequence
cctgcaggtaacagatctgtttaaacaatctagattggtaccaggaggttaataaatggcacgttcgggttttgaagtccagaaagtgacggtcgaagcactgtttctccgcgaaatccgtacgcgctttggcaagtttcgcctgggctatctgtgggcgatcctggaaccgagcgcacatctgctgattctgctcgggatctttggctatatcatgcatcgcaccatgccggatatctccttcccggtgttcctgctcaatggcctgatcccgttctttattttcagcagcatcagcaatcgctccgtgggcgccatcgaagccaatcaggggctgtttaactaccggcccgtgaagccgatcgacacgatcattgcacgcgccctcttggaaacgctgatctatgtggcggtctacatcctcctgatgctgatcatctggatggcgggcgaatatttcgagattaccaacttcctgcaatttgtgctcacctggagcctcctgatcatcctgtcgtgcggtgtgggcctgatcttcatggtcgtgggcaagacgttccccgaaatgcagaaagtcttgccgatcttgctgaagccgctgtactttatttcgtgcatcatgttcccgctgcactccattccgaagcagtattggtcgtacctgctgtggaatcccctggtgcacgtcgtcgaactgagccgcgaggccgtgatgcccggttatatcagcgaaggggtcagcctgaattatctggcaatgttcaccctggtgaccctgtttattggtttggccctgtaccgtacgcgtgaggaggcaatgttgacctcatgattaagatcgaaaacctgacgaaaagctaccgcaccccggtgggccgtcactatgtcttcaagaacctgaacattgagatccccagcggcaaaagcgtggcgttcatcgggcgcaatggggcgggtaaatccacgctgttgcgcatgattgggggcatcgaccgcccggatagcggtaaaatcatcacgaataaaacgatctcgtggccggtgggtctggcaggcggcttccagggcagcttgaccgggcgtgaaaacgtgaagttcgtggcccggctgtacgcgaagcaggaggagctgaaagaaaagattgagtttgtggaagagttcgcggagctggggaagtattttgatatgccgatcaagacctattcgagcggtatgcgcagccgcctcggcttcggcctgagcatggcgttcaagttcgattactacatcgtggacgaggtgacggcggtgggggacgcccgtttcaaggaaaaatgtgcccaactcttcaaggagcgtcataaggaaagctccttcctcatggtgtcgcactcgctgaactcgttgaaagagttctgcgatgtggcaatcgtgtttaaagacgacaacgccgtgtcgttccatgaagacgtgcaagaaggcattgaagaatatatcaccgaacaaaacaactactaaacgcgtgaagaagcaatgctgacctcataacctaggttaattcggaccgaggaggttaataaatgaacatcctggtcaccggcggtgcaggctacatcggcagccacacgtcgctctgcctgctgaacaaaggctacaatgtcgtcatcattgacaatctcatcaacagcagctgcgaaagcatccgtcgcattgagctgatcgcaaagaagaaagtcacgttctacgaactcaatatcaacaacgagaaggaagtgaaccagatcctgaagaaacacaaattcgactgcatcatgcactttgcaggtgcgaaatcggtcgcagaaagcctgatcaagcccatcttctactatgacaacaacgtgagcggcaccctgcaactcatcaattgcgccatcaagaacgacgtcgccaacttcatctttagctcgtcggcgacggtgtatggggaaagcaagatcatgcccgtcaccgaagactgccatattggtggcacgctgaatccgtatggtacgtccaagtacatctcggagctgatgatccgcgacatcgccaagaaatactccgacacgaatttcctctgcttgcgctactttaatccgacgggcgcccacgaatccggtatgattggtgaaagcccggcagacatcccctccaacttggtgccgtacatcttgcaggtcgcgatggggaaactggaaaaactgatggtgttcggtggtgattatcccaccaaagacggcacgggggtccgtgactatatccatgtgatggacctggccgaagggcacgtcgcagcgctgtcctatctcttccgcgacaataacaccaactaccacgtctttaatttgggcacgggtaaaggttattcggtgctggaactggtgtccacctttgaaaagatttccggcgtgcggattccgtatgaaatcgtgagccgccgtgacggtgatatcgcggagagctggtcctcccccgaaaaggccaacaaatatctgaactggaaagccaagcgggaactcgaaaccatgctggaggacgcctggcgctggcagatgaagaatccgaatggctatatttaacggaccgttcattttcgaaaggaggttaataaatgaaccgcctggtgatcgtgggccatccgagcagcaactaccaaatcgtggaagaactcctgcatcagcgcggcatgaactccctgtgcccgtccaaacgtgagaacctctcgccccaggacatcacccagacgctgcggaaggcgtaccagtcgccggacatctatacggtgaccgattccgccgactttgaaccgctccatgtgagcaccgtctggaacggtatcgcattggatctgatgctgtccaacctgaaccagaaactgtgcggttggagcgaccccaacgcaattcacacgttggaatattggaaatcggtggatgagaacatcacctttatcctcatctacgaccaccccaaaagcatcctgacgaactacttctcggaccagaacatctccagcaactatacctcggagcatctgatcaaaaactggctggcatacaacaccgccttgctgcacttcttcctcaacaaccggggtcggtgcctgctggtgtcgagcgaacaggtgaagcgcaacgccgaggactgcatccagcaactgcaacacaaactgaaactgaaattcgggttgtcgttctccaataccatcaaccactcgctggagcagagcgtgaatgactttaagaccgccgaagcctccattacgctggaaaaagaacatcaggagatcatgtccctcagcggtattgacatcgggaccggggatatcattttcaagcaaagcgagacggaggagtacttgatcttcaacgtcctgaacgactatcccgattgcaaggaactgtactttgaattgcaatcgaacgccaacacccccttgcgggtgctggagaaggaaaactataagccgtcctttatttgggagacgttcattaaacaacgccagatcaccctcgatatcgtgaacggtctgtaccagagcagcaaaaagatcattctggacaacgaactgcacacgtccaaacagctgaacgcctatcaagccattctgaaagagctgtcggatagcaaggaagaactgatccagtatgatctgatcattaaaaacaaaaccatccaggtccaggaactggagtgcgcgatcgagaacttcgagtccctgctgaaaaaggaacagaacaaaaatgaactgcaacaacagcgcctcgaaaagctgtcgtgcgaaaaagaattgctgctcaatcagctgcatctggtgcagcaaaagctcgaacagtacttcatcgacaatcaacgtctcgaaaagaaacaactgccggagctgtatggtgcggccgaacgcatcaagcaagatatcggctaccgcctgggtgcggtgatggtgagccgctccaagacgttcctcggtctgatctcgattccgtttgcgttgatcagcgaatggcggacctggaagaagaaatatgattcggagtaccaagtgagcctgccgagcatcttcctgtacgcggataaacacgaagccgaacgggtcaagaaacacctgagctatcagctgggcaagctcatcatcaataagaacaattttccgctcggtctgatcagcctgccctttagcatctaccgtaccatccgccaattcaaacgcaccaaaaacaattcccaggtgggtgtcaagtactgcggtaagtaattcgaaaattcactagtaggaggttaataaatgagcattttgaaccaggcaatcaatctgtataagaataagaactaccgccaagccctctccctgtttgaaaaagtggcggaaatctatgatgtgagctgggtggaagccaatatcaagctgtgccaaaccgccctgaatctgagcgaagaagtggacaagctgaatcggaaagcggtcattgatatcgacgcggcaaccaaaattatgtgcagcaatgcaaaggcgatctcgctgaatgaggtggaaaagaatgaaatcattagcaaatatcgggaaattaccgcaaagaaatccgagcgcgccgaattgaaagaagtcgaacccattccgctggattggccgagcgacctgaccttgccgccgctgccggaaagcacgaacgactacgtctgggcagggaaacgtaaagaactggatgattatccgcgcaagcaactgatcatcgacggcctgtccatcgtgattccgacgtacaatcgcgccaaaatcctggcgatcaccctggcctgcctctgcaatcagaaaacgatttatgactatgaggtcatcgtcgcggatgacggttccaaggaaaacatcgaagagatcgtccgcgagttcgagtcgttgctgaacatcaaatacgtccgccagaaagactacggctaccagctgtgcgccgtgcggaacctgggcctgcgggcagcgaaatacaactacgtggcgatcttggactgcgatatggcgccgaacccgttgtgggtgcagtcctatatggaactcctggccgtggatgataacgtggcactgattggcccgcgtaaatacatcgacacgtcgaagcatacctatctggactttttgtcccagaaaagcctgatcaatgaaatcccggagattattaccaataatcaggtcgcaggcaaggtcgagcagaacaaatccgtcgattggcgcatcgaacatttcaagaataccgacaatctgcgcctgtgcaacaccccgttccggttctttagcggtggcaatgtggcgtttgcaaagaagtggctgtttcgcgcgggttggtttgacgaagagttcacgcattggggcggtgaggataatgagttcggctatcggctgtaccgcgagggttgttatttccgtagcgtggaaggcgcgatggcatatcatcaggaaccgcccggtaaggagaacgaaaccgatcgcgcggcaggtaaaaacattaccgtccagctgttgcagcagaaggtgccctacttttatcgcaagaaggagaaaatcgagagcgccaccctgaaacgtgtgcccctggtgagcatctacatccccgcgtataattgcagcaaatatatcgtgcgctgcgtcgaatcggcactgaaccaaacgatcaccgatctggaggtctgcatctgcgatgacgggagcaccgatgatacgctgcgcatcctgcaagaacattacgcaaaccacccgcgcgtccgtttcatcagccagaaaaacaaaggcatcggctccgcctcgaataccgcagtccgcctgtgccggggtttctacatcgggcagctggattccgatgatttcctggagcccgatgccgtggaactgtgtctggatgaatttcgcaaagacctgagcctcgcctgcgtgtacaccaccaatcgcaatattgatcgtgaaggtaacttgattagcaatggctacaactggccgatttacagccgcgaaaagctcacgagcgcgatgatctgccaccacttccgtatgttcacggcgcgtgcatggaacctcaccgaaggcttcaacgagagcatcagcaatgcggtggattacgatatgtatttgaaactcagcgaagtcggcccgtttaagcatatcaataagatttgctacaaccgtgtcctgcacggcgagaacacgtcgatcaagaaactggacatccaaaaggaaaaccatttcaaggtggtgaacgaaagcctgtcgcgcctcggtatcaaaaagtacaaatactcgccgctgaccaacttgaatgaatgtcgcaaatatacctgggagaagatcgaaaacgacttgtaaactagtttgaattcacttaaggaggttaataaatgaaaattgccgtggccggcgtcggctatgtgggtatcagcattgcgatcctcctctcccaaaaacacgacatcatcgccctggacatcgacccgaagaaggtccagctcattaacaagaaaatctcgccgatttgcgacccggaaatccagaagtttctctccaatcgtaagctgaacctctacgcgacgacggaaaaatacgaggcatatcgcgatgcagactacgtgatcatcgccaccccgacgaactatgatccgattaataacaactttgataccctgagcgtcgaaagcgtcgcgtgtgacgtgctgtccattaacccgaacgcgaccatcattatcaaatccaccgtccccgtcgggttcaccgaacgcctgaagcgcgatctgaacacgaataatatcatcttttccccggagttcctgcgcgaaggcaaagccctgtatgataatctctatccgagccgcattgtcgtgggcgaatcgtcggaacgcgcacggaagttcgccgaactcctgtcggaaggtgccatcaaaaaggatattccgatcctgctgacggattcgcccgaggcagaagccatcaaactgttcgcgaacacgtatctggcgatgcgtatcgcgtactttaacgagctggacacctacgcgagcgtgcacggcctggataccaaacaaatcatcgaaggcgtctccctcgatccgcgcattggtcaacattacaacaacccgtccttcggctacggcggttactgtctgccgaaggatacgaagcagctgttggccaattatcgcgacgtcccgcaaaacctgatccaggccatcgtggatgcgaatacgacccgtaaggacttcgtggccgaggacatcctgtcccgtaagcccaaagtggtcggtatctatcgcctgatcatgaaggcgggtagcgacaatttccgggccagcagcatccagggggtcatgaaacgtttgaaggccaagggtatcgagattgtggtgtacgagccggtcctgaaagaaccctacttcttcggttcctacgtcgagcgcgacatcaattcctttaaggagcgcgtcgatgtcattgtggcgaatcgccgcaccagcgaactggaagatgtctcggagaaagtctacacccgcgacctgttcggcgtcgattcgtaacttaagttgctagcaggaggttaataaatgttcaataatctcaaattcttgtggctgctcaaaaagagccgctacgtccacgcgctcgcggccatccaggatgattgccggttctggcagtcgaaacgcatcctcgcgatgtatcgtctgaatatgtactggtcgctgcataacttgacggataccccgtccgattggcgctgcaaactggcaatcaagatcgcaaaaatcgcctgcggcgacatcagcctgacgcccgagctgctgatggagttcaaggacgagttcaccgatacccatcagaaagtggaactggcgaaaaccctggcgtcctactcgccgacctttagcctgagcctgttggacaacgtggacaactgcccgctggacctgtataccgcactgcaactccggatcggcctgacccaaaaggccatctcgaccctcgcccagatcgacgcatccgatatcgtctatagcccggatatcctgctgctgcaaaataacgccttccgcgaaaccgccgaaattagcctgaatcggctgaatgaatactataaatacttcggcctcagccccgtggccttgacggacaacagctccccgctctccccgtgcaacatcatcaccagcatcccgtacccggcccagacggggccgttgatctccatcctgatgaccacctataatacgggtcgccgcgtggaaaatgcggtgatttcgctcctcaatcagacctaccgttccttcgagctgatcattgtggatgacgcgagcaccgatgacaccctgtttcgtctccagcggctcgccctcaaagacacgcgcatcaagatcattagcctgccgcagaatgtcggcacctatgccgcgaagcgtatcggcttgatccaagcgaagggcgagttcgtcacctgccacgattcggatgactggagccatccggaaaagctgttccgccaaatctcccccttgttgctcaatccgaagctcatctgctccatctcggactgggtgcgcctgcaagacaacggtattttctatgcccgcgcagtgtaccccttgaagcgtctgaatccgtcgtcgctcctgtttcgccgtgccgacgtcttgcagaaggccggtgtctgggattgtgtgaaaacgggtgcggatagcgaatttatcgcgcgtctgaagctgatcttcggcgattccacggtgcatcggatcaagttgccgctgacgctgggctcgcaccgcaccgactcgttgatgaacagcccgacgaccggctacaccagccaaggtatctcgccggatcgccagaagtattgggattcgtggtcccgctggcacatccaggcgctgcgtaacaaggaatcgctgtacattggtaacagcgatttcaccaacaagaaccgtccgttttccgcacccgactcgatcctcgtggacaccaacgccattaagacggccctgcaaagcgcccacgtcaatttcacgagcatctaagctagcttctgcagttcttatttaaatctatcaatcgatttatcggatcc

SEQ ID NO: 48 - DNA, 8016 bp, Artificial Sequence
  Synthetic Sequence
cctgcaggtaactagatcttgcatatttaaatcactatcgattacttaattaacacgtgaggaggttaataaatgagcgaacgccacttgccggatgaccagtcctcgaccattgatccgtatctgattacgagcgtccgccagaccctggccgaacaaagcgcggcactgcaaaacctgtccaaacaactggatagcggtcagtaccagcgcgtcctgaatctcatcatgaattgtaaagggcacgtcatcctgagcggcatgggtaaaagcggccatgtgggccgcaagatgtcggcgaccttggcctcgaccgggacgccctccttctttattcatccggcggaagcgttccatggtgatctgggcatgatcaccccgtatgacctgctcatcttgatttcggcgagcggtgagacggacgagatcctgaaactggtgccgagcctgaagaacttcggcaatcgcatcatcgcaatcaccaataacgggaatagcaccctggccaaaaatgcagatgcggtcctggagctgcacatggcgaacgaaacgtgcccgaacaatctcgccccgaccacctccacgacgctcacgatggcgatcggggacgcgctggccatcgcgatgattcaccagcgtaagtttatgcccaatgactttgcacgctaccaccccggtggcagcctgggtcggcgcctgctgacccgcgtcgccgacgtgatgcaacatgatgtgccggcagtgcagctcgatgccagcttcaaaacggtcattcagcgcatcacctcgggctgccagggtatggtgatggtcgaagatgcggaaggtgggctggcaggcatcatcaccgatggcgatctgcggcgctttatggagaaagaagacagcctgacgagcgcaacggccgcacagatgatgacccgcgaaccgctgaccttgcccgaagacaccatgatcatcgaagcagaagagaagatgcagaaacaccgcgtctcgaccctgctggtgaccaacaaagcaaataaggtgaccgggttggtgcgcattttcgattaacacgtgttgtcgacaggaggttaataaatgctgatcaaagtgaaaagcgccgtctcgtggatgcgtgcgcgtctgagcgcgatcagcctggcagatattcagaagcacctggcaaaaatcattattctggcacccatggcggtgctgctgatctacttggcgatcttctcccagccccgctatatgtcggaaagcaaggtggccatcaagcgcagcgacgatctcaactccggcagcctgaacttcggcctgctgttgggtgcctccaacccgtcgtccgccgaagacgcactgtacctgaaggaatacatcaacagcccggatatgctggccgcgctggataaacagctgaacttccgcgaagcgttctcccattcgggcctggacttcctgaaccatctgtccaaggatgaaaccgccgaggggttcctgaagtactataaagatcgcatcaacgtcagctacgacgacaagaccgggctgctgaacatccagacccagggcttttcgcccgagttcgcgctgaaattcaaccagaccgtgctcaaggaatccgagcggttcatcaatgaaatgtcgcaccgtatcgcccgcgatcaattggcgtttgcggaaaccgaaatggaaaaagcgcgccagcggctggatgcatcgaaagccgaattgttgtcctaccaagacaacaacaatgtgctggacccgcaggcacaggcccaggcggcatccaccctggtgaatacgctgatgggccagaaaattcagatggaagccgacctgcgcaacctgctcacgtacctgcgcgaggatgcgccccaagtcgtgagcgcccgcaatgcaattcagagcctccaggcacagatcgacgaagaaaagtcgaaaattaccgcaccccagggcgataaactgaaccgcatggccgtggattttgaggagatcaaatccaaggtcgagttcaataccgagttgtacaagctcacgctcaccagcatcgaaaagacccgtgtcgaagcggcccgtaagctgaaagtcctgagcgtgatctcgtccccgcagctgccccaggaaagctccttcccgaatatcccgtatttgatcgcgtgttggctgctggtgtgttgcctgctctttggcaccctgaaattgctcctggcggtgattgaagaccaccgtgactaagtcgacttctcgaggaggttaataaatgaagctgtttaagtcgatcctgctgatcgcagcgtgccatgcagcacaggcgagcgcaaccatcgacattaatgccgatccgaacctcacgggtgccgcaccgttgaccggcatcctgaacgggcagaaaagcgacacccagaacatgagcggcttcgataacaccccgccccccgcacccccggtcgtgatgagccgtatgttcggggcgcagctgttcaacggtacgagcgcagactcgggggcaaccgtgggtttcaatccggactacatcctgaatcccggcgattccatccaggtccgcctgtggggtgcgttcaccttcgatggcgcactccaggtggacccgaagggcaacatcttcctgccgaatgtcggccccgtcaaagtcgcaggtgtgtcgaactcccagttgaacgcgctggtgacgagcaaggtgaaggaagtctaccagagcaacgtgaacgtctatgcgtcgctcttgcaggcgcagccggtcaaggtctatgtgaccggctttgtccgcaaccccggcctgtacggcggtgtcacctccgacagcctgctgaactacctgatcaaggcgggtggtgtggacccggaacgcggcagctacgtggacatcgtcgtgaaacgcggcaatcgtgtgcgctcgaacgtcaacctctatgacttcctgctcaacggcaaactggggctgtcccagtttgcggacggtgatacgatcattgtgggtccgcgccagcatacgttctcggtgcagggcgatgtgttcaattcctacgactttgaatttcgcgaatcgagcatcccggtcaccgaagcactgtcctgggcacgtcccaaaccgggtgcgacccatatcacgattatgcggaagcagggcctccagaagcgctcggaatattatccgatctcgtccgcaccggggcgtatgctgcaaaacggtgataccctcattgtctccaccgaccgctatgcgggcaccattcaagtgcgtgtggaaggcgcacattccggggaacacgccatggtgctgccctacggtagcaccatgcgggccgtgctcgaaaaagtgcgcccgaactccatgtcgcagatgaacgccgtgcagttgtatcggccgagcgtcgcgcaacggcagaaagaaatgctgaatttgtccctgcaaaagctcgaagaggccagcctcagcgcacagagcagcaccaaggaagaggccagcctgcgtatgcaggaagcccaactgatctcccgcttcgtcgcgaaagcccgcaccgtcgtgccgaagggcgaagtgatcctcaatgaaagcaacattgactccgtcctcctggaggacggcgacgtgatcaatattcccgaaaagacgtcgttggtcatggtccacggggaagtgctgttcccgaacgcggtgtcgtggcagaaaggtatgacgaccgaggactacatcgagaagtgcggtgggctgacccagaagtccggcaacgcccgtattatcgtcatccgtcagaacggcgcagcggtgaacgcagaagacgtcgattccctgaaacccggtgatgaaattatggtgttgccgaaatacgagtcgaagaacatcgaagtgacgcgcggtatcagcaccattctgtaccaactggcggtgggcgcgaaagtgattctgtcgctgtaactcgaggaggttaataaatgtcgaaggccgtgattgtgatcccggcacgctacggcagcagccgtctgccgggcaaaccgctgctggatatcgtcgggaaaccgatgatccagcacgtctacgaacgggccctgcaagtggcaggcgtggcagaggtgtgggtcgcaaccgacgacccgcgtgtggagcaggcagtccaggcgttcggcggcaaagcgatcatgacccgcaacgatcatgagagcggcaccgatcgcctggtggaagtcatgcataaggtggaggcggatatctatatcaacctgcaaggggatgagccgatgattcgcccgcgtgacgtcgaaaccctgctgcaaggtatgcgggacgacccggcgctgccggtggcgaccctgtgtcatgcgatcagcgcggcagaagccgccgaaccgtccaccgtcaaggtcgtggtgaacacgcggcaggacgccctgtatttctcccgctcccccattccgtacccgcgcaacgccgagaaggcgcgctacctgaagcacgtcgggatctacgcctatcggcgggatgtcctgcaaaattacagccagttgccggagtccatgcccgaacaggccgaatccctggagcaactgcggctgatgagcgcgggcattaacattcgcaccttcgaggtcgccgcgaccggtcccggcgtcgataccccggcgtgcttggagaaggtccgggccctgatggcgcaggagctcgcggagaacgcatgattggcatttatagccccggcatttggcgtattccgcacctggaaaaattcctcgcccagccctgccaaaagctgtcgctgctgcgcccggtcccgcaggaagtggatgcaatcgcggtgtgggggcaccgcccctcggccgcaaagccggtggccatcgccaaagccgcaggcaagccggtgatccgcttggaggatggtttcgtccgctcgctggacctgggcgtgaacggtgaaccgcccctctcgctcgtcgtggatgactgcggcatttactacgacgcctcgaaaccgagcgcgctggaaaaactcgtgcaggacaaggccggcaacgcggccctggcggatcaggcgcgcgaggcgatgcacaccattgtgacgggcgacatgagcaagtacaacctggcaccggcgttcgtggcggatgaaagcgagcgcacgaacatcgtgctggtggtggaccagaccttcaatgacatgagcgtgacctacggcaacgcaggcccccatgagttcgccgcaatgctggaagcagcgatggcggaaaacccgcaggcagaaatctgggtcaaagtgcatcccgatgtcctggaagggaaaaagaccggctacttcgcggacttgcgtgccacccagcgcgtgcgcctgattgcggaaaacgtgtcgccgcagtccctgctgcgtcatgtgtcccgcgtgtacgtcgtgacctcccagtacggttttgaagccctgctggccggtaagcccgtgacctgctttggccaaccctggtatgcagggtggggcctcaccgatgaccgccacccccaatcggcgctgctgtcggcgcgtcgcggctcggccaccctggaggaactgttcgcagcggcctatctgcgctattgccgctacattgatccgcagaccggggaggtgtcggccctgttcacggtgctccaatggctccagctgcaacgtcgtcacctgcaacagcggaatggttatctctgggtgccgggcctgaccctgtggaaaagcgcgatcctgaagcccttcctgcaaacggccacgaatcgtctctccttttcccgtcgctgtaccgcagcaagcgcctgcgtcgtgtggggcgtgaaaggcgaacagcaatggcgtgcggaggcacagcgcaaatccctgccgctgtggcgcatggaagacggcttcctgcgcagctccggcctggggagcgatctgctgccgccgttgagcctggtcctggataagcgcggtatctattacgatgccacccgtccgtcggaactggaggtcctgctgaatcacagccagctgaccctcgcgcaccagatgcgcgcggaaaagttgcgccaacgtctggtggaaagcaaattgagcaaatataacctgggggccgatttcagcctcccggcagaagcgaaggacaagaaagtcatcctggtgccgggccaggtggaagacgatgcgtcgattaagacgggcaccgtgtcgatcaagtcgaatctggagctgctgcgcaccgtgcgggaacgtaatccgcacgcctacatcatctacaagccgcaccccgatgtgctcgtcggcaaccgtaagggtgacattccggcggaacagatcgcggaactcgcagactaccaggcactggatgccgatatcattcagtgtattcagcgtgcggacgaggtgcacacgatgacgagcctcagcggctttgaagcattgctgcacggtaaacaggtgcactgctacggcctgccgttctacgcctcgtggggcctgaccgtcgatgagcaccactgcccccgtcgcgagcggcggctgaccatcgccgacctgatctatcaagccctgattgtctatcccacctatattcatccgacgcggttgcagccgatcacggtggaggaagcggcagaatatctgatcaaaacgccccgcaaacccatctttatcacccgcaagaaagccggccgtgtgattcgctactatcgcaagttgatcatgttctgcaaagtgcgctttggttaagagctcgccgaaaacgcttaacaccgcgtgttaggaggttaataaatgcacggcaatgcgctgacggtgctgttgagcggtaaaaagtacctcctgctccaaggtccgatgggtccgttcttcaacgatgtggcggaatggttggagagcctcggtcgcaacgcggtcaacgtcgtctttaatggcggtgatcgcttctactgccgccaccgccaatacctggcgtactaccaaaccccgaaggagttccccggttggctgcgggacttgcatcgtcagtatgactttgacacgattttgtgtttcggtgactgccgcctgctgcacaaggaggccaaacgctgggccaagtcgaaggggattcgttttctggccttcgaggaaggctacctgcgtccgcaatttatcaccgtggaagaaggcggtgtgaacgcctatagcagcttgccccgcgatccggacttttaccgcaaattgcccgatatgccgacgccgcacgtcgagaacctgaaaccgagcaccatgaagcgcatcggccacgccatgtggtattacctgatgggttggcactatcgtcacgaatttccgcgctatcgccaccacaaatcgttcagcccgtggtatgaagcgcgctgctgggtccgcgcctactggcgcaaacagctgtataaggtcacccaacgcaaggtcctcccccgcctgatgaacgagctggatcagcgctattacctggcggtcctgcaagtgtacaacgacagccagatccgcaaccatagcaactataatgatgtgcgtgattacatcaacgaagtgatgtacagcttttcccgcaaggcccccaaggagtcctatctggtgatcaaacatcacccgatggatcgcgggcaccgcctgtaccgcccgttgatcaagcgtctgtcgaaggaatacggtttggatgaacgtgtcatctatgtgcacgatctgcccatgccggagctgttgcgccacgccaaagcggtggtcaccatcaatagcacggccggcatttccgcgttgatccacaacaagcccctgaaagtcatgggcaacgccttgtacgatatcaagggtctgacgtaccaggggcatttgcatcagttctggcaagccgactttaaaccgaacatgaagttgtttaagaaatttcgcggctacttgctggtgaagacccaggtcaatgcggtgtactacggcgaaatgatctttaacaaaattaagaagtataagaaacgttaacaccgcgtgttctgcagaagtttaaacaatctagattggatcc

SEQ ID NO: 49 - DNA, 4213 bp, Artificial Sequence
  Synthetic Sequence
gaattcaaagcttattaggaggattaataaatgttgaagaacttgaccttcgatcacatcctgagcctgagcaagaaagaagataaaatcaaactggtgcagctcatcgtcaaccatctggacgagcgcacgctgtcctgcatcaagaacatttcgaccggcaaaggctttaatgcgcatctcaaaatcctggagttgttcgacttgtggctgtcggaatacttcgagtatattatcatcccgaacaagttgtcgaacgcagggacgttttacttcgcgttcttctttccggagttctacatcaaacgtttcaacaagaataacacggacctgtccagcttgggtgataccagcttcaagcgcctgatgagccgtccgcacatccccaactacgtgtataatctcgtgatcaactcgaacggctgcaccttcaattcgattaagttgttgctgctcgcactgtccctgaccagcaaacgcttctacgaaaccccgcagcaggagcgcaacttcttgtgccacatcaatgaaattgtcctggcaaacgccgacgaatatagcggcatcatttcctgtatcatcaaatcgcgcatctcggtgattgatgatttcattagcagcaatgtgagcctgaataccaatcgccagatcgcattgttcatcacggggcagtcgcgcggtttcatcgacgcgctgccgaacctggtcagcaagatcacgattccgtcggacgtcgatgtgtttatctccacctggaaggatatcgggcatacgcaactgagcaaagaacgcatctgccgcatttttgattcggaagccgcccaatacgtgtccgaacccgacaattacagcttcgtggatgaacattatgatgagctgaaagacctgtcgctctcctcctataagaacaataacctggaagaaatctactcgtcgttcttctccggctgcaactccgtcctgatcaatatcaaggatgatggcgaatatccgtataacaagatgagcaacgcggaaaagatgtactaccacaattccttttggttctgctcgctgaaaaatcataactgggataagtaccgctgcatcatcaaaatccgccccgatgccctgctgcaagtggataacgtgaccatcaacgatatcgacgtggacgacagcgtgtattgcgaggacagcaacggttggatttttcgcgagtgggggtttggcatcggcgatcagctgttctatggcgacccggacatcatgaagaaactgatgtgcgtgcatggtctggataacatttactcgcaactgacgagcctgatctcgtcgtcgaatgtgtactactcggggcacatcaacgtcggcttgtgcgcctgggccaatgtgtacgactgtaaagtgagcaatctgaagatcaagaatattgtggccccgcgtaaaatcagcctggagcaaattctgagcctgcgggaataaaagcttaccttggtttatattaaggaggttaataaatgaagaaaattatcgtcgatctggataatacgattagcttcaatctgagcggcaaatacagccatgcaacccccaataagaaattgatcgaaaaactctatgagtacaagctgaacggtttctacatcgtcatctttaccgcgcgcaatatgcggacgtacaaggaaaacattggcaagatcaatattcatacgctgccggtgatcatcgactggctgaacgaaaaccgcgtcccgtatgacgaggtgattgtcggcaagccgtggtgcggcgacgagggcttctatgtggacgatcgggccatccggccctcggaactgtgcaatatgaccttggaagaaatctctaatatgttagaacaggagaaaaaatgcttctaataatgtctggtagctacgtgcagcaggaattgggcgcggagttcggtagcatcccgccgtcgttcctgccgttggcaaacaagcgtctgttcaagcaccaggtcagcttggggcacgatggccatgcgatctacctggtcctgccggaagatttcgtgttcgacaaacacgattacgaatggttgctgcgcaataaagtgacgatgattccggtcgatagcaatctgaccctgggccaggcaatcgtcacggcctggaatctgatcggcgacaaagatgataaaggcctgcaactgctgtttggtgataccttgttcaagaagattccggcgggtgatgacctcgtggcgatctcccattccgatgataactaccagtggtcctttttctatgagacggaattgcgggcagtctcccgcgaggacaacaaaaatgtcatctgcgggtacttctcgttcagcaaacccaatttcttcattcgcgaactggtcaccagcaagtttgacttcacggcagccctgaaaaagtaccatgattcgtacagcttggcgtcgatttacgtcagcgactggctcgatttcggtcacatcaatacctactataagtcgaaagtccagtacacgacccagcgtgccttcaatgagctgtgcatcacgaccaagtccgtgattaagtcctcctcgaatgaaagcaagatcgaggcagaatcgaaatggttcgagacgattccgggtgaactgaaaatctacaccccgatgttgctggaaccgttcgatcacattcgcaaaagctacaaactcgaatacctgtacaataccaccctgaacgaactgttcgtgttctcccgcctgccgaataatatcctgaccaacattctgatcagctgcctggattttatcgacctctgcaaagagtatcatagcattgatacggataaaaacattctccaggatctgttttacgaaaagaccatcgagcgcgtcagcaagtatatcaccgatctcaacattgacccgaacgcgaaatggaattttaacaacaatattagcgtgagcatcaacgacatcctgtacgacacgaacaaattcattccgtccgaactgcaatacaagaccatcatgcacggggacctgtgcttcagcaatattatctttaacttccgcacgggccggattcaggtgttcgatccgcgcggtctgaaccacagcggcgaaatctcgatctatggcgatttccgctacgatattgcgaaactgtcgcactccattctaggcctgtatgactggatcatcgcgggctactacattatcaacaaaaagaataagacccattccattgagttcaaaatcaatattgataacaaactctttgaaatccaatcgaccttcgtgtccattattaaggaaaaatacagcatctccgaaaagtcgctgtacgccatgcaaattcatctgttcttgtcgatgctgccgttgcatagcgacgacaagaagcggcaggacgccctgtttgcgaatgccttccgcctgtatgaaatctttaaggaggcagcagtatgattattatcccgatggcaggtatgtcgagccgctttttcaaagccggttatagcaaaccgaagtatatgctggagctgaatggcgagtttctgttcgatttgtgcctcaagagcttcaaactgtacttcgagacggaacactttgtcttcatcctccgtgacgtgtttaacacgaaatcgttcgtgctccagcgtatcgccagcctgggcattaatagctatacgctgatcaccctggataaggaaacgcggggtcaagcagagacggtctatttggccatctcgaaactgtttaatatcgaacagccgatcaccatcttcaacatcgacacgattcgtcccaacttcatcttcaccaagttcgagggcgagaatgaatgttacattgaagtgtttcgcggcgatggcgacaactggtcgttcgtgatgcccagcaatgacgtcaaaaatgaagtgattgccacgtccgaaaagaaacagattagcaatttgtgttgcaccgggctgtaccacttcagcacgatcaaaaactttatttccgcgtatgaacattacaagaacctgccgcaagaaaactgggatgcgggcgagctgtatattgcgccgatctacaattacctgatctccaatgggatcaaagtgtattataccgaaatcaataagtccgacgtgatcttctgcggcaccccgcgtgagtatgagaatctccaggggaaaaagtaagaatgcctttcgtctgtacgaaatcttcaaagaagctgcggtataagaattc

SEQ ID NO: 50 - DNA, 30 bp, Artificial Sequence
  Synthetic Primer
ggcgcgccagcgtcctgctgtttgatgacg

SEQ ID NO: 51 - DNA, 26 bp, Artificial Sequence
  Synthetic Primer
aagcttgccaggagattgacgccagc

SEQ ID NO: 52 - DNA, 29 bp, Artificial Sequence
  Synthetic Primer
ggcgcgccggaatcctcagttggacccgc

SEQ ID NO: 53 - DNA, 28 bp, Artificial Sequence
  Synthetic Primer
tctagaactttaccctcacggtccagcg

SEQ ID NO: 54 - DNA, 21 bp, Artificial Sequence
  Synthetic Primer
ccgaattgttatcttgcctgc

SEQ ID NO: 55 - DNA, 22 bp, Artificial Sequence
  Synthetic Primer
ggtagcatctctttgggtatcg

SEQ ID NO: 56 - DNA, 20 bp, Artificial Sequence
  Synthetic Primer
gaacagcggttgagtcaggg

SEQ ID NO: 57 - DNA, 21 bp, Artificial Sequence
  Synthetic Primer
ggcagaaagcacatagcgacc

SEQ ID NO: 58 - DNA, 31 bp, Artificial Sequence
  Synthetic Primer
ttaattaacaaaggtttcgttaacaaagcgg

SEQ ID NO: 59 - DNA, 28 bp, Artificial Sequence
  Synthetic Primer
ttaattaaattggttttcgctcgctcgc

SEQ ID NO: 60 - DNA, 27 bp, Artificial Sequence
  Synthetic Primer
aagcttggaagacgccatctatggtgg

SEQ ID NO: 61 - DNA, 24 bp, Artificial Sequence
  Synthetic Primer
tctagagaagcccgccagcaccgc

SEQ ID NO: 62 - DNA, 20 bp, Artificial Sequence
  Synthetic Primer
ccgttgatgtggtgactgcc

SEQ ID NO: 63 - DNA, 20 bp, Artificial Sequence
  Synthetic Primer
aaacagcagcgttctcaccg

SEQ ID NO: 64 - DNA, 30 bp, Artificial Sequence
  Synthetic Primer
cctgcagggtcgaacactcgcaagaccagg

SEQ ID NO: 65 - DNA, 30 bp, Artificial Sequence
  Synthetic Primer
cctgcaggtatccgcatcatcgtgctgacg

SEQ ID NO: 66 - DNA, 19 bp, Artificial Sequence
  Synthetic Primer
ccttggtgatggtgtggcg

SEQ ID NO: 67 - DNA, 20 bp, Artificial Sequence
  Synthetic Primer
gcccatccacgactcgaacg

SEQ ID NO: 68 - DNA, 20 bp, Artificial Sequence
  Synthetic Primer
gaccaatgacacgatgatcg

SEQ ID NO: 69 - DNA, 20 bp, Artificial Sequence
  Synthetic Primer
gcatccgctacaacatgctc

SEQ ID NO: 70 - DNA, 26 bp, Artificial Sequence
  Synthetic Primer
agatctggcggtaacaggggattggc

SEQ ID NO: 71 - DNA, 28 bp, Artificial Sequence
  Synthetic Primer
gcggccgccaagacggtattcgggctgc

SEQ ID NO: 72 - DNA, 29 bp, Artificial Sequence
  Synthetic Primer
gcggccgcgatctgctggtgttcttccgc

SEQ ID NO: 73 - DNA, 26 bp, Artificial Sequence
  Synthetic Primer
agatctcctaccgaccaggcattggc

SEQ ID NO: 74 - DNA, 18 bp, Artificial Sequence
  Synthetic Primer
ccgaatttccgagcctgg

SEQ ID NO: 75 - DNA, 17 bp, Artificial Sequence
  Synthetic Primer
gcccgctcgcttcgtcg

SEQ ID NO: 76 - DNA, 19 bp, Artificial Sequence
  Synthetic Primer
acgtggatgcggtcgtcgc

SEQ ID NO: 77 - DNA, 17 bp, Artificial Sequence
  Synthetic Primer
ggggcttgcgggtcggc

SEQ ID NO: 78 - DNA, 21 bp, Artificial Sequence
  Synthetic Primer
cgtatgctgagaatgacgacc

SEQ ID NO: 79 - DNA, 470 bp, Artificial Sequence
  Synthetic Sequence
ttcgaattgtcgacttaggcgcgccactcgagccttcttagaaggccatcctgacggatggcctttttgcgtttctacaaactcttcatatgtaatgaaagcttgtcagcctgcagtgtccggtttgatagggataagtccagccttgcaagaagcggatacaggagtgcaaaaaatggctatctctagaaaggcctaccccttaggctttatgcaacagaaacaataatcctgcaggtctattaattaaccaacatcgattacactggatccttaaatgattcggctacgcgacttgcgtagccgatttttttgattcttgtacattacttagtatgcttcacttgtggatacttcgagtaattgactagatcagtgacacggtaccagagagaaaaaacgtgcgccgactgacggcgcacgaagacattaacgatgagctctggcgcgccgatagtcgacgattcgaa

SEQ ID NO: 80 - DNA, 127 bp, Artificial Sequence
  Synthetic Sequence
ttaattaatgtttctgttgcataaagcctaaggggtaggcctttctagagatagccattttttgcactcctgtatccgcttcttgcaaggctggacttatccctatcaaaccggacactgcatcgat

SEQ ID NO: 81 - DNA, 20 bp, Artificial Sequence
  Synthetic Primer
aaggcgacaaggtgctgatg

SEQ ID NO: 82 - DNA, 20 bp, Artificial Sequence
  Synthetic Primer
caatgcgacggatgctttcg

SEQ ID NO: 83 - protein, 211 aa, Artificial Sequence
  Synthetic Sequence
MGSLNKGYNVVIIDNLINSSCESIRRIELIAKKKVTFYELNINNEKEVNQILKKHKFDCIMHFAGAKSVAESLIKPIFYYDNNVSGTLQLINCAIKNDVANFIFSSSATVYGESKIMPVTEDCHIGGTLNPYGTSKYISELMIRDIAKKYSDTNFLCLRYFNPTGAHESGMIGESPADIPSNLVPYILQVAMGKLEKLMVFGGDYPTKDGT

SEQ ID NO: 84 - protein, 220 aa, Artificial Sequence
  Synthetic Sequence
MGSWLAYNTALLHFFLNNRGRCLLVSSEQVKRNAEDCIQQLQHKLKLKFGLSFSNTINHSLEQSVNDFKTAEASITLEKEHQEIMSLSGIDIGTGDIIFKQSETEEYLIFNVLNDYPDCKELYFELQSNANTPLRVLEKENYKPSFIWETFIKQRQITLDIVNGLYQSSKKIILDNELHTSKQLNAYQAILKELSDSKEELIQYDLIIKNKTIQVQELEC

SEQ ID NO: 85 - protein, 182 aa, Artificial Sequence
  Synthetic Sequence
MRGSHHHHHHGSAISLNEVEKNEIISKYREITAKKSERAELKEVEPIPLDWPSDLTLPPLPESTNDYVWAGKRKELDDYPRKQLIIDGLSIVIPTYNRAKILAITLACLCNQKTIYDYEVIVADDGSKENIEEIVREFESLLNIKYVRQKDYGYQLCAVRNLGLRAAKYNYVAILDCDMKLN

SEQ ID NO: 86 - protein, 124 aa, Artificial Sequence
  Synthetic Sequence
MGSVDLDNTISFNLSGKYSHATPNKKLIEKLYEYKLNGFYIVIFTARNMRTYKENIGKINIHTLPVIIDWLNENRVPYDEVIVGKPWCGDEGFYVDDRAIRPSELCNMTLEEISNMLEQEKKCF

SEQ ID NO: 87 - protein, 199 aa, Artificial Sequence
  Synthetic Sequence
MGSPEDFVFDKHDYEWLLRNKVTMIPVDSNLTLGQAIVTAWNLIGDKDDKGLQLLFGDTLFKKIPAGDDLVAISHSDDNYQWSFFYETELRAVSREDNKNVICGYFSFSKPNFFIRELVTSKFDFTAALKKYHDSYSLASIYVSDWLDFGHINTYYKSKVQYTTQRAFNELCITTKSVIKSSSNESKIEAESKWFETIP

SEQ ID NO: 88 - protein, 184 aa, Artificial Sequence
  Synthetic Sequence
MRGSHHHHHHGSASLGINSYTLITLDKETRGQAETVYLAISKLFNIEQPITIFNIDTIRPNFIFTKFEGENECYIEVFRGDGDNWSFVMPSNDVKNEVIATSEKKQISNLCCTGLYHFSTIKNFISAYEHYKNLPQENWDAGELYIAPIYNYLISNGIKVYYTEINKSDVIFCGTPREYENLQG

SEQ ID NO: 89 - protein, 195 aa, Artificial Sequence
  Synthetic Sequence
MGSVGFTERLKRDLNTNNIIFSPEFLREGKALYDNLYPSRIVVGESSERARKFAELLSEGAIKKDIPILLTDSPEAEAIKLFANTYLAMRIAYFNELDTYASVHGLDTKQIIEGVSLDPRIGQHYNNPSFGYGGYCLPKDTKQLLANYRDVPQNLIQAIVDANTTRKDFVAEDILSRKPKVVGIYRLIMKAGSDN

SEQ ID NO: 90 - protein, 247 aa, Artificial Sequence
  Synthetic Sequence
MRGSHHHHHHGSDDTLFRLQRLALKDTRIKIISLPQNVGTYAAKRIGLIQAKGEFVTCHDSDDWSHPEKLFRQISPLLLNPKLICSISDWVRLQDNGIFYARAVYPLKRLNPSSLLFRRADVLQKAGVWDCVKTGADSEFIARLKLIFGDSTVHRIKLPLTLGSHRTDSLMNSPTTGYTSQGISPDRQKYWDSWSRWHIQALRNKESLYIGNSDFTNKNRPFSAPDSILVDTNAIKTALQSAHVNFT

SEQ ID NO: 91 - protein, 225 aa, Artificial Sequence
  Synthetic Sequence
MGSMIKIENLTKSYRTPVGRHYVFKNLNIEIPSGKSVAFIGRNGAGKSTLLRMIGGIDRPDSGKIITNKTISWPVGLAGGFQGSLTGRENVKFVARLYAKQEELKEKIEFVEEFAELGKYFDMPIKTYSSGMRSRLGFGLSMAFKFDYYIVDEVTAVGDARFKEKCAQLFKERHKESSFLMVSHSLNSLKEFCDVAIVFKDDNAVSFHEDVQEGIEEYITEQNNY

SEQ ID NO: 92 - protein, 159 aa, Artificial Sequence
  Synthetic Sequence
MRGSHHHHHHGSLAIAMIHQRKFMPNDFARYHPGGSLGRRLLTRVADVMQHDVPAVQLDASFKTVIQRITSGCQGMVMVEDAEGGLAGIITDGDLRRFMEKEDSLTSATAAQMMTREPLTLPEDTMIIEAEEKMQKHRVSTLLVTNKANKVTGLVRIFD

SEQ ID NO: 93 - protein, 188 aa, Artificial Sequence
  Synthetic Sequence
MRGSHHHHHHGSACELPEFALKFNQTVLKESERFINEMSHRIARDQLAFAETEMEKARQRLDASKAELLSYQDNNNVLDPQAQAQAASTLVNTLMGQKIQMEADLRNLLTYLREDAPQVVSARNAIQSLQAQIDEEKSKITAPQGDKLNRMAVDFEEIKSKVEFNTELYKLTLTSIEKTRVEAARKLK

SEQ ID NO: 94 - protein, 223 aa, Artificial Sequence
  Synthetic Sequence
MGSLNYLIKAGGVDPERGSYVDIVVKRGNRVRSNVNLYDFLLNGKLGLSQFADGDTIIVGPRQHTFSVQGDVFNSYDFEFRESSIPVTEALSWARPKPGATHITIMRKQGLQKRSEYYPISSAPGRMLQNGDTLIVSTDRYAGTIQVRVEGAHSGEHAMVLPYGSTMRAVLEKVRPNSMSQMNAVQLYRPSVAQRQKEMLNLSLQKLEEASLSAQSSTKEEAS

SEQ ID NO: 95 - protein, 249 aa, Artificial Sequence
  Synthetic Sequence
MGSMSKAVIVIPARYGSSRLPGKPLLDIVGKPMIQHVYERALQVAGVAEVWVATDDPRVEQAVQAFGGKAIMTRNDHESGTDRLVEVMHKVEADIYINLQGDEPMIRPRDVETLLQGMRDDPALPVATLCHAISAAEAAEPSTVKVVVNTRQDALYFSRSPIPYPRNAEKARYLKHVGIYAYRRDVLQNYSQLPESMPEQAESLEQLRLMSAGINIRTFEVAATGPGVDTPACLEKVRALMAQELAENA

SEQ ID NO: 96 - protein, 256 aa, Artificial Sequence
  Synthetic Sequence
MGSQRVRLIAENVSPQSLLRHVSRVYVVTSQYGFEALLAGKPVTCFGQPWYAGWGLTDDRHPQSALLSARRGSATLEELFAAAYLRYCRYIDPQTGEVSALFTVLQWLQLQRRHLQQRNGYLWVPGLTLWKSAILKPFLQTATNRLSFSRRCTAASACVVWGVKGEQQWRAEAQRKSLPLWRMEDGFLRSSGLGSDLLPPLSLVLDKRGIYYDATRPSELEVLLNHSQLTLAHQMRAEKLRQRLVESKLSKYNLGA

SEQ ID NO: 97 - protein, 251 aa, Artificial Sequence
  Synthetic Sequence
MRGSHHHHHHGSACELCFGDCRLLHKEAKRWAKSKGIRFLAFEEGYLRPQFITVEEGGVNAYSSLPRDPDFYRKLPDMPTPHVENLKPSTMKRIGHAMWYYLMGWHYRHEFPRYRHHKSFSPWYEARCWVRAYWRKQLYKVTQRKVLPRLMNELDQRYYLAVLQVYNDSQIRNHSNYNDVRDYINEVMYSFSRKAPKESYLVIKHHPMDRGHRLYRPLIKRLSKEYGLDERVIYVHDLPMPELLRHASLIS

SEQ ID NO: 98 - DNA, 86 bp, Artificial Sequence
  Synthetic Sequence
gctagctaattcttgacatagtttcacagattgtgttataataactacacgacgttcatcgtcgtcaatgtacaggaggtcaacaa

SEQ ID NO: 99 - DNA, 36 bp, Artificial Sequence
  Synthetic Primer
ggccgcggcgcgcctgcaggatttaaatctcgaggc

SEQ ID NO: 100 - DNA, 36 bp, Artificial Sequence
  Synthetic Primer
ggccgcctcgagatttaaatcctgcaggcgcgccgc

SEQ ID NO: 101 - DNA, 31 bp, Artificial Sequence
  Synthetic Primer
cgtcaagcttgtgaacgcctatagcagcttg

SEQ ID NO: 102 - DNA, 30 bp, Artificial Sequence
  Synthetic Primer
cagtggcgcgccgagcgatgataagctgtc

SEQ ID NO: 103 - DNA, 25 bp, Artificial Sequence
  Synthetic Primer
gcactgcagatcccctttatccgcc

SEQ ID NO: 104 - DNA, 39 bp, Artificial Sequence
  Synthetic Primer
cttcttcggctatgcatcgttcgtaatcaagccacttcc

SEQ ID NO: 105 - DNA, 38 bp, Artificial Sequence
  Synthetic Primer
gattacgaacgatgcatagccgaagaagggatgggttg

SEQ ID NO: 106 - DNA, 27 bp, Artificial Sequence
  Synthetic Primer
gcactgcagatccacatccttgaaggc

SEQ ID NO: 107 - DNA, 1604 bp, Artificial Sequence
  Synthetic Sequence
ctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcag

SEQ ID NO: 108 - DNA, 29 bp, Artificial Sequence
  Synthetic Primer
cgcaagcttcgtaccgaaagatcagttgc

SEQ ID NO: 109 - DNA, 41 bp, Artificial Sequence
  Synthetic Primer
ccaaaagagaaatctgcagtagatgggatgttattttaccg

SEQ ID NO: 110 - DNA, 38 bp, Artificial Sequence
  Synthetic Primer
acatcccatctactgcagatttctcttttggggcacgg

SEQ ID NO: 111 - DNA, 28 bp, Artificial Sequence
  Synthetic Primer
gctctagacatctgccataacaacggag

SEQ ID NO: 112 - DNA, 1750 bp, Artificial Sequence
  Synthetic Sequence
gctctagacatctgccataacaacggagaaagcgccatcgccgttaacagtcgacggcgcgaaataagaggtaagccgctcatcaataaacaaaactcacaggtgcagcacccgccggatgcggcaaaatacccatcgggatgccataaatcatttcgagggtttcgccgcgcataatttccgcaggcgttccctgagcaatcatttcaccgccgcgcagggcgaccagataatcacagtagcgtgccgccatattgatatcgtgcaacacggcaatgaccgtcaggccacgctcctgacttaaacggtgcaccagcgacagcacatcaacctggtgggcgatatccagcgccgaggtcggttcgtcgagcaacagacaacggctatcctgcgccaccagcatggcgatccacgcccgctgacgttcgccgccagagagactatcgaccagccgatgcgccagcggttttaagccaaccagcgagatagcttcctcgactttttcgcgatctgccgccccaaagcgccccagcgcgccatgccacgggtaacgaccaatcgccaccagttcacgcacggtcatcccttctgccggaggaagctgctgcggcaaataagccactttgcgggcaaacgctttgctgctccagctttccagcggttgggcatcaagaagaatctccccttccgacggcggctgatgacggccaagcattttgagcagagtggatttaccagaaccgttgtgaccaatcagaccggtcactttcccggcaggaaaggttaacgacagcggatgcaaaagcgtgcgcccgggcacacgaaaggagatattacgcagtgcaaaagtggtatcggaatgattcgtgtattcctgcataacagccaacttgtgaaatgggcacggaaatccgtgccccaaaagagaaatctgcagtagatgggatgttattttaccggatggcaactcgccatccggtatttcacgcttagatgttaattactaccaaacatatccttgatccaaccggctacaccgtcgctgtctttctgctcttgctgagcaggttgctgttgcggctgttgctgcggctgagaagactgatcaaacggattgcctgacggctgctgctgcatctcgctctgctggcacagcgattgcggatcgctggtccagaccggcaagatacgcatgccaccgctgcaaacaaagttgccgtcgtagtccacgcccatatctgcaatatcttctggcggaacaagattcagcggcgttggcgtctggttagccagataacgctgataaatcgacattgccccgctggcaccatacagtttggtcggctggttgttatcacggccgacccaggtgatggtcaccgtgctgccgtcaatgcccgcaaaccaggtatctacgttattgttggtagtccctgttttccctgccagatgcaggttcgggtatttcgccccaagctgacgacccgtaccgcgttgtaccacctgctgcatggtccatagtgtcagatacgccgcctgcgccggaacagcgcgttccgcctgcgggaagctctgatacagcactttgccatcttccgcgattaccgaacgcagcgcagaaagcggtgcacggttaccaccgctggcgatggtctggaatgcctgcgccacttcgattggcgttaagttcaacgcccccagcagcattgccggaaccggatgcaactgatctttcggtacgaagcttgcg

SEQ ID NO: 113 - DNA, 58 bp, Artificial Sequence
  Synthetic Primer
gcgagatctcatgtttgacagcttatcatcgctcggctttaatgcggtagtttatcac

SEQ ID NO: 114 - DNA, 30 bp, Artificial Sequence
  Synthetic Primer
ccggcgtacaagatccacaggacgggtgtg

SEQ ID NO: 115 - DNA, 30 bp, Artificial Sequence
  Synthetic Primer
ctgtggatcttgtacgccggacgcatcgtg

SEQ ID NO: 116 - DNA, 27 bp, Artificial Sequence
  Synthetic Primer
gcggatccttccattcaggtcgaggtg

SEQ ID NO: 117 - DNA, 23230 bp, Escherichia coli
gcatggactgaccatggttttatattcattaaaaattttgttacaacccattgatttagcataaataaattatagtgggttcgggtttgttgtgactgtggcattatttccgtgcaaaggagctgatatgtctgaaagacatttacctgatgaccagagcagtactatcgatccatatctaattacctctgttcgccagactctggcagaacaaagcgcagcattacaaaacttgtctaaacaactggattccgggcagtaccagcgtgtccttaatttgataatgaactgtaaagggcacgttattctttcgggaatgggtaaatcagggcatgtcggtcgtaaaatgtcagcgacgctggcctctacgggtacgcctagtttctttattcatcctgcagaagctttccatggcgatctgggcatgattacgccttacgatcttctgatccttatttctgccagcggtgaaacggatgaaatcctcaagctagttccttcactgaaaaatttcggcaaccgaattatcgccattaccaataatggaaattccacgctggcgaaaaatgctgatgccgtgctggaactccacatggcgaatgaaacctgcccgaataatcttgcaccaacaacgtctaccacgctgacgatggcgatcggcgatgcgctggcgattgccatgatccaccaacgcaaatttatgccgaatgattttgcgcgctatcacccgggcggttcattaggtcgtcgcctgctgacccgcgttgctgatgtcatgcagcatgatgttcctgcggtacagctggatgcgtcatttaaaaccgtgattcaacgtatcaccagcggatgccagggaatggtgatggtagaagacgcagaaggtgggctagcgggcattatcaccgacggtgacctgcgtcgctttatggaaaaagaggattctctgacatccgccacggctgcgcagatgatgacacgtgaaccgctgacgctaccggaagacaccatgatcattgaagcggaagaaaaaatgcaaaagcaccgcgtctcaacgttattggtgaccaacaaggcaaataaagtcactggccttgtgcgcattttcgactaattaagcaacggggtgcgagaggttagtctctcattgagtttgcgccccactgaaactttgataatcgttacatgttgataaaagtgaagtctgccgtatcctggatgcgtgctcgtctgtctgccatctcactggcagatatccaaaaacacctggcgaaaatcatcattctggcaccgatggcggtgctgctgatctatctggctatcttcagccagcctcgctatatgagcgagtcgaaagtcgccattaaacgctcggatgatttaaacagcggcagcctgaattttggtctgcttctgggtgcctctaaccccagttccgcagaagatgcgttgtatctgaaagagtacatcaactcgccggatatgctggcggcgctggataagcaactaaattttcgtgaagcgtttagccacagcgggctcgattttcttaatcatcttagcaaggatgaaaccgcagaaggcttcctgaagtactacaaggaccgtatcaacgtctcgtatgacgataaaaccggattactgaatattcagacgcagggctttagcccggagtttgcgcttaagtttaaccaaaccgtgctgaaagagtcagagcgctttatcaatgagatgtcacatcgcatcgcgcgtgaccagcttgcctttgcagaaacggagatggaaaaggcacgccagcgtctggacgccagcaaagcggaattgctctcttatcaggacaacaacaacgttctggatccacaggcacaggcacaggcggcgagcacgttagtgaatacgctgatgggccagaagatccagatggaagcggacctgcggaacttgctgacgtatctgcgtgaggacgccccgcaagttgtgagtgcgcgtaatgcgattcagtcattgcaggcacaaattgacgaagaaaaaagcaaaatcactgcgccacagggtgacaagctaaaccgtatggcagtggattttgaagaaatcaaatcaaaagtagagttcaacaccgagctgtacaaactgaccctgacctccattgaaaagacccgtgtagaagcggctcgtaagctcaaggtgctgtcagtgatcagttcgccacagttgccgcaggaatcgtcttttccaaatatcccttatttgatcgcctgctggttactggtgtgctgcctgctgttcggcaccctgaaactgttgctggctgttattgaagatcaccgagactaacgctgtcgctgaatgagtttgtgatgaaattatttaaatcaattttactgattgccgcctgtcacgcggcgcaggccagcgcgaccattgatattaacgctgacccaaacctgacaggagccgcgccgcttaccggtattctgaacggacagaagtcggatacgcaaaacatgagcggcttcgacaataccccgccgcccgcaccgccggtggtaatgagccgtatgtttggtgctcaacttttcaacggcaccagcgcggatagcggtgcgacggtaggattcaaccctgactatattctgaatccgggtgatagcattcaggttcgcttgtggggtgcgttcacctttgatggtgcgttacaggttgatcccaaaggtaatattttcctgccgaacgttggtccggtgaaagttgctggcgtcagtaatagtcagctaaatgccttggtcacatccaaagtgaaggaagtataccagtccaacgtcaacgtctacgcctccttattacaggcgcagccagtaaaagtgtacgtgaccggatttgtgcgtaatcctggtctgtatggcggtgtgacgtctgattcgttactcaattatctgatcaaggctggcggcgttgatccagagcgcggaagttacgttgatattgtggtcaagcgcggtaaccgcgtgcgctccaacgtcaacctgtacgacttcctgctgaacggcaaactgggactttcgcagttcgccgatggtgacaccatcatcgtcgggccacgtcagcatactttcagcgttcagggcgatgtctttaacagctacgactttgagttccgcgaaagcagcattcccgtaacggaagcgttgagctgggcgcgccctaagcctggcgcgactcacattacgattatgcgtaaacaggggctgcaaaaacgcagcgaatactatccgatcagttctgcgccaggccgtatgttgcaaaatggcgataccttaatcgtgagcactgaccgctatgccggcaccattcaggtgcgggttgaaggcgcacactccggtgaacatgccatggtattgccttatggttccactatgcgtgcggttctggaaaaagtccgcccgaacagcatgtcgcagatgaacgcagttcagctttatcgcccatcagtggctcagcgtcagaaagagatgctgaatctctcgctgcaaaagctggaggaagcctcactttctgcccagtcatccaccaaagaagaagccagcctgcgaatgcaggaagcacaactgatcagccgctttgtggcgaaagcacgcaccgtggttccgaaaggtgaagtgatcctcaacgaatccaatattgattctgttctgcttgaagatggcgacgtcatcaatattccggagaaaacatcgctggttatggttcatggcgaggtgctgttcccgaacgcggtgagctggcagaaagggatgaccaccgaggattacatcgagaaatgcggtggcctgacgcaaaaatcgggtaacgccagaattatcgtcattcgtcagaacggtgcggcagtcaacgctgaagatgtagattcactcaagcctggcgatgagattatggttctgccgaaatatgaatcgaaaaacattgaagttacccgtggtatttccaccatcctctatcagctggcggtgggtgcaaaagtgattctgtctttgtaaggggttgaaatgagcaaagcagttattgtcattccggctcgctatggctcctcgcgcctgccgggtaagccactgctcgatattgttggtaaaccgatgatccagcatgtttacgagcgtgcgttacaggtggcgggcgttgcggaagtttgggtggcaacagacgatccgcgtgttgaacaggccgtacaggcgtttggcgggaaagccatcatgacgcgcaacgatcatgaatccggcaccgatcggctggtcgaggtgatgcataaagtcgaggcagatatctacattaacctgcagggcgacgaaccaatgattcgcccgcgggatgtagaaacgctgctacaaggaatgcgtgacgatcccgcgttgccggtggcaacgctatgccacgcgatttctgccgcagaagcggctgagccaagcacggtaaaagtggttgtgaatacccgccaggatgcgctttatttcagccgctcaccgattccgtatccgcgtaatgctgaaaaagcgcgctacctgaaacacgtcggtatttacgcttatcgtcgcgatgtgctgcaaaactacagccagttaccggagtccatgccggagcaggcggaatcactggagcagctgcggttgatgagcgcggggatcaacatccgcacatttgaggttgccgcaaccggtccgggcgtcgacaccccagcatgcctggaaaaagtgcgcgccctgatggcacaggaactggctgaaaacgcatgattggcatttactcgcctggcatctggcgtattccgcatctggagaaatttctggcgcaaccgtgccagaaactttctctgctgcgccctgttccgcaagaagttgatgctatcgccgtgtggggacatcgtcccagtgcggcgaaaccagtcgccatcgccaaagcagcgggaaaacccgtcattcgtctggaagatggatttgtgcgttcgctggatcttggcgtcaatggcgagccgccgctttctctggtggtggatgattgtggcatttactacgatgccagcaagccttcggcgctggagaaactggtacaggataaagccggaaatgcggcattggctgatcaggccagagaagcgatgcacaccatcgtgaccggggatatgtcgaaatataatctggcgcctgcgtttgtggcggatgaatcagaacgtacaaacatcgttctggttgtcgatcagacatttaatgatatgtcagtgacgtatggcaatgctggcccgcatgagtttgctgccatgctggaagccgcgatggcggaaaatcctcaagctgaaatttgggtgaaggtgcacccagatgtactggaaggaaagaaaacaggttatttcgccgatctgcgcgccacgcaacgagtacgtttaattgccgagaatgtcagcccgcagtcgctgttgcgacacgtttcccgggtttacgtcgtgacatcccaatacggctttgaagccttgctggcaggaaaaccagtaacatgtttcggccagccctggtatgcaggctggggcttaaccgacgatcgccatccgcagtccgctttgttatctgcccgacgcggttctgccacgctggaggaactttttgccgctgcatacctgcgttactgtcgctatatcgatccgcaaacgggagaagtaagcgctctatttaccgtgctgcaatggctgcaattacaacgtcgacatctgcaacagcgtaatggttatttatgggtgccaggcttaacgctgtggaagtcagcgatcctgaaacctttcttgcaaacggcaacaaaccggctgagtttttcacgtcgctgtactgcggcgagcgcctgcgtggtatggggtgtaaagggagaacagcaatggcgagccgaagcgcagcgaaaatcactgccgttatggcgaatggaagatggttttctgcgttcatccggacttggctctgaccttttgccaccgctatcgctggtgctggataaacgcggaatctactatgacgccacgcgccccagcgaactggaagtgctgcttaatcatagccagctaacgctggcgcatcagatgcgagctgaaaaattacgccagcgactggttgaaagtaaactgagcaagtacaacctgggagccgatttctctctaccagccgaagccaaagataaaaaagttatcctggtgccgggtcaggtagaggacgatgcctctattaaaacaggcactgtgtcgattaagagcaaccttgagttattacgcacagtacgcgagcgcaatccgcacgcctacattatttataaaccgcacccggatgtattagtggggaatcgcaagggcgatattccggcagaacagattgctgaacttgctgattatcaggcactggacgcagatattattcaatgcatccaacgcgcagatgaagtgcataccatgacgtcgctgtcggggtttgaagcgttattacatggcaagcaagttcattgttacggcctgcccttctatgccagttggggtttaaccgttgatgaacatcattgcccgcgccgcgagcgcagattaacgatagcagacttgatctatcaggcgttgattgtttatccaacctatatccacccaacacggctacaacctattacggttgaagaagctgcggaatatttaatcaagacaccgcgaaagccgatatttattacccgaaaaaaagcggggcgggtaatacgctattaccgcaaattaattatgttctgcaaggtcagatttggctaaacaatttcatagttgactattacgcaaattatttatgcacggtaatgcactaaccgttttattatccggtaaaaaatatctgctattgcaggggccaatgggaccttttttcaatgacgtcgccgaatggttagagtcattaggccgtaacgctgtgaatgttgtcttcaacggtggggatcgtttttactgccgccatcgacaatacctggcttactaccaaacgccgaaagagttccccggatggttacgggatctccaccggcaatatgactttgataccatcctctgctttggcgactgccgcctattgcacaaagaagcaaaacgttgggcaaagtcgaaagggatccgctttctggcatttgaggaaggatatttacgcccgcaatttattaccgttgaagaaggcggagtaaacgcatattcatcgctaccgcgcgatccggatttttatcgtaagttaccagatatgcctacgccgcacgttgagaacttaaaaccttcaacgatgaaacgtataggtcatgcgatgtggtattacctgatgggctggcattaccgccatgagttccctcgctaccgccaccataaatcgttttccccctggtatgaggctcgttgctgggttcgtgcatactggcgcaagcaactttacaaggtaacacagcgtaaggtattaccgaggttaatgaatgagctggaccagcgttattatcttgccgttttgcaggtgtataacgatagccagattcgtaaccacagcaattataacgatgtgcgtgactatattaatgaagtcatgtactcattttcacgtaaagcaccgaaagaaagttatttggtgatcaagcaccatccaatggatcgtggtcacagactctatcgaccattaattaagcgattgagtaaggaatatggcttagatgagcgagtcatttatgtgcacgatctcccgatgccggaattattacgccatgcaaaagcggtagtgacgattaacagtacggcggggatctctgcgctgattcataacaaaccactcaaagtgatgggcaatgccctgtacgacatcaaaggcttgacgtatcaagggcatttgcaccagttctggcaggccgattttaaaccgaatatgaaactgtttaagaagtttcgagggtatttattggttaagacgcaggttaatgcggtttattatggggagatgatttttaacaagataaaaaaatataaaaaaagataaaaaagattgtattatgctatcaaaaaaacatcacaatgaatggcattaacataaccattcataaactcccattcattaaataaatgattaacatactataattagaaaacacaataaattattaaaataaatattatagattatacatttagtgataagttatatactggtaaagttaacatgagcactttgtaatgcagttttgatggcattagtatctactaatattgagtcgggcgcagaaaatggtcgatttttattagtgaaatcagaatttcctatgtaaagactttctttatttcttaacgcctgaatgtgccatcgcgaccaggaatcccaatatttttggcgatctggtgaaattccctgagatgtatatcctgttgtaggtgaattcattaacgagtcggtacgatggcttcctagcgtcaaaggcaatttaatacgatgtacagtggaatcaccaaaaattagcttaagtcgagcaatgaattcactatcagcccccgttttaacacagtcccaaacgcccgctttttgcaatacatccgctcttctaaacaacagagaagaaggattcagtctttttagtggatagaccgcacgcgcatagaaaatcccattatcttgcaaccttacccaatcagaaatcgaacaaattagtttagggtttaacaataaaggtgatatctgtctaaataatttttcaggatgggaccagtcatctgagtcatggcatgtcacaaactctccctttgcctgtattaagcctattcgttttgcagcatatgttccaacattttgtggcaggctaataatttttattcgagtatctttgagtgctaatctctgaagacggaatagcgtatcatcggtgctggcatcatccacaataattagctcaaatgaacggtatgtttgattaagcaatgatattactgcattttctacccgcctaccggtattgtatgttgtcattaaaatagaaatcagggggcccgtttgggcaggataaggaatcgatgtaataatattacaaggtgacaaaggagatgagttatctgtcagtgcgaccggagataaaccaaagtacttatagtattcgttaagtctatttaacgagatttctgccgtttctctgaaagcattattttgcaagagtaatatatcaggggaatatacaatatcactggcatcaatctgagcgagtgttgatatagctttttgagttaacccgattcttaattgaagagctgtatacaagtctaagggacaattatcgacattatctaataatgataatgaaaacgtaggagagtatgatgctaaggtttttgctaactcaactttttgatgtgtgtctgtgaactcgtctttaaactccatgagtaattccggagttaagcttatgtcaccacaggcaattttagctattttgattgctaatttacaccgccaatctgacggtgtatcagtaagattatgtaatgaccaatacatattaagcctgtacattgccaatatacgttttgactgccaaaatcggcagtcatcttgtattgcagctaaagcatgtacatatcgacttttctttaatagccataaaaattttaaattattgaacataatcaagagtcgacaccaaataaatctcgcgtataaactttttcacttacatcttctaattctgacgtgcggcgattggctactataacatcaacacgttctttaaaagaattaatatcacgctcaacataagaaccaaagaaataaggctcttttagtacaggttcatatacaactatctcaattcctttggctttgagtcgtttcattacaccttgaatactacttgctctaaagttatcactacctgctttcattatgaggcgatagattcctacaacttttggtttacgacttaatatatcctccgcaacaaagtcttttcgggtagtattggcatcgacaatagcctggattaagttctgcggaacatcacgataatttgcgagtaattgcttggtatccttaggtaagcagtaacctccataaccaaaagaaggattattataatgttgaccaattctaggatctaaactaacaccctctataatttgctttgtatctaaaccatgaacggaggcataagtatccaattcattgaaataagcaatccgcattgcaaggtaagtatttgcaaaaagtttaatggcttcagcttcagggctatccgttaacaatattggaatatctttttttatagcgccttcactgagaagctctgcgaactttcttgctcgttcgctactctctcccacaactatacgagatggatataggttgtcataaagagctttaccttcacgtaaaaattctggggaaaagataatattattcgtgtttagatcgcgttttagtcgttcagtaaatccgacggggactgtagatttaattatgatagttgcattaggatttatacttagtacgtcacatgctactgattctactgagagtgtatcgaagttattattaatgggatcataattggttggtgttgcgattataacataatcagcatctctatacgcttcgtatttttctgttgtagcatataggtttaattttctattagataaaaatttttgtatttcaggatcacatattggtgatatttttttattaatcaactgaactttcttaggatctatatcgagagcgataatatcatgtttttgtgaaagtaatatagcaattgatataccaacatatcctacaccagcaactgcaattttcataatagattatatttaattccgtgtataaaatcaaagaaatgtgattaagcattgataacaataaattatcagatttattaggccaaacctaatttttatttttttccttgcaaattttcatattctctaggagtaccacaaaaaataacatcagacttatttatttctgtataatacactttgatcccattactaattagataattgtatattggggctatatataactctccagcatcccaattttcttgaggtagatttttataatgttcatatgctgaaataaaatttttaattgtagaaaaatgatataatcctgtgcagcataagttagaaatttgttttttttcgctagtagcaatgacctcattttttacatcatttgatggcataacaaaagaccagttatccccatctcctcgaaatacttcaatataacattcattttccccttcgaacttagtaaatataaaattaggcctaattgtatcaatgttaaaaatagtgattggttgttctatattaaataattttgatatagccaaatatactgtttctgcttgcccccgagtttctttatcaagagtaatcaaggtgtagctattaatccctaaagatgctattctttgtaatacaaaagacttcgtattgaaaacatccctaaggataaagacaaaatgttcagtctcaaaatataatttgaaacttttcaaacatagatcgaatagaaactcaccattcaattcaagcatatattttggtttggaatatccagccttgaaaaaacgcgaactcatccccgccattggaattataatcatactgcagcctccttaaaaatttcatataatctaaatgcattagcaaatagtgcatcttgcctttttttgtcatcggaatgaaggggaagcattgataaaaataaatgtatttgcatcgcatacaatgatttttcggagattgaatatttctcttttattatagaaacaaatgttgattgaatttcaaacaatttattatcaatattaattttgaattcaatactatgagttttattttttttatttattatataatatcctgcaattatccaatcatagagccctagtattgaatgtgataatttagctatatcataacgaaaatcaccataaatacttatttctccagagtggttcaatcctctgggatcaaaaacttgtattctaccagttctaaagttaaaaattatattactaaagcataaatcgccatgcataatagttttatattgcagttcacttgggataaatttattagtatcataaagaatatcattaattgaaacgcttatattattattaaaattccattttgcatttggatcaatatttaaatctgttatgtacttgctaacccgctcaatcgttttttcataaaataaatcttgcagtatatttttgtcagtatcaattgaatgatattctttgcacagatcgatgaagtctaaacaacttattaatatatttgttaaaatattatttggtaggcgagaaaaaacaaataattcatttaacgtcgtattatataaatattcaagcttataactctttctgatatgatcaaacggttccaataacattggagtatagatctttaattctccgggaatagtttcaaaccattttgattcagcttcaattttactttcatttgaacttgatttgataacggattttgttgtaatgcataattcattaaatgcacgctgggttgtgtattgtacttttgacttatagtatgtattaatatgtccaaaatcaagccaatcagacacgtatatagaagctaaactatagctgtcgtgatactttttaagtgccgccgtaaaatcaaattttgaagtaactaattccctaataaaaaaattcggtttactaaaagaaaaatacccacaaattacatttttattatcttctctactgacggctcttaactctgtttcgtaaaaaaatgaccattgataattatcatcagaatgacttattgctactaaatcatcccctgcaggaatttttttaaagagtgtatcgccaaacaataattgtaagcctttgtcatctttatctcctattaaattccatgcggtaactatcgcttgccctaatgtcaagttactatcgacaggaatcattgttactttattacgaagcaaccattcataatcatgtttgtcaaacacaaaatcttccggtaaaaccagatatattgcatgaccatcatgccctaaagatacttgatgcttaaataatcgtttattagctaaaggaagaaagcttggaggaatagaaccaaattcggcccctaattcttgttgaacataggaaccagacattattagaagcattttttctcctgttctaacatattagaaatctcttctaaggtcatattgcaaagttctgatggtcgaatagctctatcatcaacataaaacccctcatctccacaccaaggtttaccaacaatcacctcatcataagggactctattttcattcaaccaatcaattataactggtaatgtatgaatattaatcttacctatattttctttatatgtcctcatattccttgctgtaaaaataacaatataaaaaccattaagcttatattcatacaatttttcaattagttttttgtttggagttgcatgtgaatattttcctgataaattaaaagatatggtgttatctaaatctacaattatttttttcatatagtgcatctttcattgttaagtgatatctataccttgcaataaataactcattcccgcaaagaaagtatttgttctagcgatatttttcgaggcgctacaatattttttatttttaaattagaaaccttgcaatcatatacattagcccaagcacataaccctacattaatatgacctgaataataaacattagaacttgagatcaaggatgttagctgactatatatattatctaaaccatggacacacatcagctttttcattatatcaggatcgccgtaaaataattggtcgcctatgccaaacccccattctctaaatatccacccattactatcctcacaataaacagaatcatctacatctatatcattaattgtcacattatcaacttgcaataaagcatcaggccttatctttataatgcacctatatttatcccaattatgatttttaagactacagaaccaaaatgaattatggtaatacattttttctgcattactcattttattatatggatattccccatcatctttaatgtttattaaaactgagttacatccagagaaaaaacttgaatatatctcctctaaattattatttttatatgaacttaagctcaagtcttttaattcatcatagtgttcgtctacaaacgagtagttatctggctctgaaacatattgtgcagcctcgctgtcaaatatcctacatattctttctttagataactgtgtgtgtccgatatctttccatgtactaataaaaacatcaacatcagaaggaatcgttattttacttacgagattaggtagggcatctataaaacctcttgattgtccagttatgaataaagctatttgcctgtttgtatttaatgaaacattacttgaaataaagtcatcaattacagatattctactttttataatgcaagaaatgataccggagtattcgtcagcattagccaagacaatttcatttatatgacacaaaaaattacgttcttgctgaggtgtttcataaaacctttttgatgttagactaagagccagcaataataatttaatggagttaaaagtacatccattagagtttatcacaagattgtaaacatagtttggtatatgtggtcgactcataagtcgtttaaaagatgtgtctcctaacgaggaaagatcagtattattcttattgaatcttttaatataaaactcgggaaaaaagaatgcaaaataaaaagtccctgcattgcttaacttattaggtataataatatattcaaaatactcactcaaccataggtcaaaaagttcaagtatttttaaatgagcattaaatcccttaccagtagagatattttttatacagcttaatgttctctcatctaaatgatttacaattaattgtacaagtttaattttatcttctttctttgaaagacttaatatatgatcaaatgttaagttttttagcatgttggatttgcccctatgtttccagatacctgttatcacttaacccatcactggcccactgccgcagatattcccgtggcgagcgataacccagcgcactatgcggatgccattcgttataatgctcgaacgcctctgcaaggttctttgctgccgttaacccgtctggtttgggcatgatacttatgtagtcacgctttatcgttttcacgaagctctctgctattccgttactctccggactccgcactgccgtgttcttcggttcaagtcccaacatcctggcgaactgacgtgtttcattcgcccggtagcatgaaccattatccgtcagccactccactggagacgccggaagctcgctgccaaagcggcgttccactgctcccagcatgacgtcctgtactgtttcactgtcgaagccacccgttgtgaccgcccagtgcagtgcctcacggtcacagcagtccagcgcgaacgtgacccgcagtttttctccgttatcacagcggaactcaaacccgtcagagcaccatcgctgattactttctttcacagccactctgccggtatgtgcccgtttcgatggcggtacagcgggttttcgctcaagcaacagcgcattctggcgcatggtccggtaaacacgtttggcattgatcgcaggcataccatcaagttctgtttgtctgcgaagcagcgcccatacccgacgataaccatacgtgggcagctctccgataacatggtgtatacggcgaagcacatccgtatcatccgtgtgacggctgcggcggccgtccttccagtcatcggctcgtctgagaatgacgtgcaactgcgcacgcgacacccggagacaacggctgacgaagcttactccccatccccgggcaataagggcgcgtgcgctatccacttttttgctcgcccatattcaacggcttctttaaggagttcattttccatcgtttttttgccgagcagacgctggagttctttaatctgcttcatggcggcagcaagttcagaggcaggaacgacctgttctccggcagccacagcagtaagacttccctcctggtattgcttacgccagagaaatagctggctggctgccacaccatgttgccgggcaacaagggagaccgtcattcccggttcaaagctctgctgaacgatagcgatcttttcctgtgtagtacgccgtctgcgtttctccggccctaagacatcaatcatctgttctccaatgactagtctaaaaactagtattaagactatcacttatttaagtgatattggttgtctggagattcagggggccagtctacatgtttatcacttgtaatatatcaataattataaatcattctctattttttcccaggtatattttctacattcattcaaattagttaatggtgaatatttatatttttttatgcctagcctacttaatgattcgttaacaactttaaaatgattttccttttgaatatccaacttttttatagacgtattttcaccatgcaatacgcgattataacaaattttgtttatatgcttgaacggtccaacttcactaagttttaaatacatatcgtaatcaactgcgttgctgatcgattcgttgaaaccttcagttaggttccatgctcttgctgtgaacatcctgaaatgatgacatatcattgcactagtaagtttttctcgcgaataaatgggccaattatagccatttgatatcaaattaccttcacgatctatattacggttagttgtataaacacatgccaatgatagatcttttctaaattcatctagacatagttcaacagcatctggttcaagaaagtcatcagagtctaactgacctatatagaatccccgacacaatctaactgctgtattagatgctgaaccaattcctttgtttttttgtgaaataaaacgaactcgaggatggtttgcataatgctcctgaagaatccgcaatgtatcatctgtggaaccatcatcgcatatgcatacttctaagtcagttattgtctgattaagggcgctttcaacacaacgaacaatatatttagagcagttataggcgggaatatatatagatactagtggtactctttttaatgtcgcggattctattttttctttttttctatagaaataaggaactttttgctgtaacaattgaacagtaatatttttccctgccgcacgatccgtctcgttttctttcccgggtggttcttgatgatatgccattgctccttcaacagaccgaaagtaacatccttctctgtagagacgatatccaaactcattatcctcccccccccaatgcgtaaactcttcatcaaaccatcctgcacggaaaagccattttttcgcaaaagcgacattacctccgctaaaaaatcgaaatggtgtgttgcataatcttagattatcggtatttttgaaatgttctattcgccagtcaactgatttgttttgctcaaccttgcctgcaacctgattattagtaatgatttcaggaatttcatttattagtgatttttgggaaaggaaatctaaatatgtatgcttgcttgtatctatatattttctagggccaattagagcaacattatcgtccaccgctaatagttccatatatgactgaacccatagtgggttcggagccatatcacaatccagaattgcaacataattatactttgcagccctaagcccaagatttctaacagcacacagttgatatccataatccttctgacgtacatattttatatttaataaactttcaaattctcttactatttcttcaatattttctttacttccatcatcggcaacaataacttcatagtcgtatatggtcttttggttacaaagacaagcaagtgtaattgcaagtatttttgctcgattatatgtaggaattacaatactaagcccgtcaatgattaactgttttcttggataatcatcaagctcttttcttttccccgcccaaacataatcgtttgtgctctcaggtaacggcggtaaagttaaatcactaggccaatctaaaggaatgggttcgacttcctttaactccgcccgttctgatttctttgcggttatttctcggtatttgcttattatttcatttttttcaacctcgttcagactaattgctttggcgttagaacacattatttttgttgctgcatcaatatcaataacagctttacgatttaacttatcaacttcttcagaaagattgagtgcggtttggcataattttatatttgcttcgacccaactaacatcataaatttcagcaaccttctcaaaaagagataaagcttggcgataatttttgtttttatataaatttattgcttgattaagaatactcatattatttcaacctaatctagtataattaaagtatcaacacgcataataatcatgtccctatatatatattttcatgcgatatcataatcttgccccattaaatcctaattgatacttgaagaaatattgagaatcgtatttttaatttattattttatttttttaattaaataaagcgtaaaccactatgacttaaacaattagaaaaaagctatttcacttaactaagaaaattttcactattaattcgcacgcatttatagccgatattttaactttatatttagtagcctggatttattttccacagtatttaacccctacctgagaattattttttgttcttttgaattgacgtattgttctgtatatcgaaaatggcaaagatatcaaccctagtggaaaattatttttatttatgattaattttcctaattgataggataaatgttttttcaccctttctgcctcatgtttatcagcataaagaaatattgatggcagagagacttgatattcactatcgtatttctttttccatgttcgccattcggatatcaaagcaaaaggaatgctaattaatcctaaaaatgtttttgaacgactaaccattacagcacccaggcgatatccaatgtcctgttttatacgttctgctgcaccatataattctggaagttgttttttttctaatcgttgattatcaataaaatattgttcaagtttttgttgtactaaatgcaattgattaagcagtagttctttttcacaacttaatttttccaatctttgttgttgcaattcatttttattttgttctttctttaacagcgattcaaaattttctatggcgcattcaagctcctgaacttgtattgtcttattttttattattaaatcatattgaatcaattcttctttagagtcactcaattcttttaaaatagcctgatatgcatttaattgttttgatgtgtgtaactcgttatctaaaattatttttttagaggactgatataatccattgacaatatctaatgttatttggcgttgttttataaatgtctcccatataaaggaaggcttgtaattttccttttctaaaaccctaagcggagtatttgcattagattgtaattcaaaataaagctctttacaatctggataatcattcaatacattgaaaattaaatattcctctgtttcactctgtttgaatataatatctccggttcctatatcaatacctgatagagacattatttcctgatgctctttttccagagtaatcgaagcttcagccgtcttaaaatcatttacagattgttctagtgaatgattaatcgtatttgaaaatgaaagaccaaatttcaacttaagcttatgttgaagttgttgtatgcaatcctctgcattacgtttgacttgttctgagcttactaataaacacctaccgcgattattaagaaaaaagtgtaacaatgctgtattataggcaagccagtttttaattaaatgttctgacgtatagttggacgatatattttgatctgaaaaataatttgttaaaatagactttggatgatcgtaaattagaataaatgtaatgttttcatcaacactcttccaatattctaatgtatggattgcattaggatccgaccatccgcacaatttttggttcaaattactaagcatcaagtcaagggctataccattccagacagtagaaacgtgtaatggttcgaaatcagcactatctgttacagtgtatatatcaggggattgatatgccttacgaagcgtctgagtgatatcttgggggcttaaattttctcgcttcgatggacatagagaattcattcctctttgatgcaaaagttcttctacaatttgataattagagctcggatgaccaactattactagtctattcatgatgttttatccccccaaggcagaaaaccctttattcgccatttgtttagttagctttaattaacaccccatctactttttagtgtctacgaatttattaaaccaattcaccacactaaatttcgattattaagatgccaatagatatagaagttatcgtaaaattttgctttaccttatgcatgattaaatataaccatttgggtttttcatttgccagcgccaggcatcctcaagcattgtttccaattcccttttagctttccaattgagatacttatttgctttttctggtgatgaccaactttcagcaatatccccatctcttctcgaaacaatttcatatggaattctaaccccagatattttttcaaaggtagaaaccagctctaaaacagaatatcctttaccagtacctaaattaaaaacatgataattagtgttattatcacggaaaaggtaagataaagcagccacatgcccttccgctaaatccattacgtgtatataatcacgaacaccggttccatcctttgtagggtaatcccccccaaacaccataagtttttctagtttacccatagcaacttgtaatatataaggaactaaattgcttggtatatcagcgggactttcaccgatcattcccgactcgtgagcacctgttgggttaaaatatctcagacacaaaaaattagtatcgctatatttttttgcaatatctctaatcatcaattctgatatatactttgatgtaccatatggatttaatgttcctcctatatggcaatcttctgtaacaggcattattttgctttcaccataaaccgttgcagaagagctaaaaataaaattagccacatcgttttttatagcgcaattaattaattgcaacgtccctgaaacattattatcataataaaaaatgggttttattaaagattcagcaacagactttgcaccggcaaaatgcattatacaatcaaatttgtgtttttttagaatttgattaacttctttttcattgttgatgttcaactcatagaaagtaactttttttttagctattaattcaatccttcgaatgctctcgcaagatgaattaattaagttgtcaatgattacaacattgtaacctttattcagaagacataaactagtatgcgagccaatatagcctgctccacctgtaactaatatattcatttttcacccttgaaaacaacatcagtaattattttgttccgttatatactcttctatcccctcctgaacatcctcatgaaaactaaccgcattgtcatccttaaaaacaatggccacatcacaaaactctttcaatgaattcaaactatgtgaaaccattaaaaaactagattctttatgcctttctttaaacaattgagcgcatttttctttaaacctggcatcaccgactgcggttacttcatcgacgatataataatcaaatttaaatgccatacttaaaccaaagcctaggcgagatcgcataccagaggagtaagttttgatcggcatatcaaaatacttgccgagttcggcaaattcttcaacaaactcaattttctctttcagttcttcttgcttcgcgtataacctcgcgacaaattttacattttcgcgtccggttaaacttccctgaaatccacctgcaaggccgactggccatgatatcgttttattggtgatgatctttccgctatcggggcggtcaatgccaccaatcattctcagtaacgttgatttacccgcaccattacgaccaataaaggcaacactttttcctgaagggatttcaatatttaaattcttaaagacataatgtcgacccactggcgtgcgatatgacttcgtcaaattttcaatcttaatcatgatgtcagcattgcctcttcacgcgttcggtataacgccagaccgatgaacagggtgaccagagtgaacattgcaaggtagttcagactcacgccttcgctgatatagccaggcataactgcctcgcggcttaactctacgacatgcactaatgggttccagagtagatatgaccagtattgctttggaatcgagtgtaaagggaacatgatgcaggagatgaaatacagcggcttaagcagtatcggcaggaccttttgcatttcagggaaagtcttaccaacgaccatgaatattaagccaacgccacatgaaagaatgattaacaaactccaggtaagcacaaattgtaaaaagtttgttatttcgaaatattcgcctgccatccagatgataagcataagcaatatataaacagcaacgtaaatcagtgtctcaagcaatgcacgcgcaatgatcgtatcgatgggttttactggtcgataattaaacagcccctgattcgcttcaatagcacctacagaacgattgctgatactgctaaagataaaaaagggaatcaggccattaagtaaaaacaccgggaatgagatgtctggcatcgtgcggtgcataatgtaaccaaaaatgcccaacagtatcagcaaatgcgcagagggttcgagaatcgcccacagatatcccagacggaacttaccaaagcgtgttcgtatttctcgtagaaataatgcctctacggtgactttctggacttcaaatccacttcttgccatttgatgatgtgaccctattctcttcaggtatgctaccgcccctggcttaacagctaccaatacactggaggtaatacttgtttgtaactggataaaatttactcagacgg

SEQ ID NO: 118 - DNA, 20 bp, Artificial Sequence
  Synthetic Primer
gcacctccatgagacattgc

SEQ ID NO: 119 - DNA, 20 bp, Artificial Sequence
  Synthetic Primer
ccactgccatacggtttagc

SEQ ID NO: 120 - DNA, 20 bp, Artificial Sequence
  Synthetic Primer
gcttgcctttgcagaaacgg

SEQ ID NO: 121 - DNA, 20 bp, Artificial Sequence
  Synthetic Primer
ccaacaatatcgagcagtgg

SEQ ID NO: 122 - DNA, 20 bp, Artificial Sequence
  Synthetic Primer
gtcattcgtcagaacggtgc

SEQ ID NO: 123 - DNA, 19 bp, Artificial Sequence
  Synthetic Primer
ccagtgcctgataatcagc

SEQ ID NO: 124 - DNA, 20 bp, Artificial Sequence
  Synthetic Primer
ggcttaacgctgtggaagtc

SEQ ID NO: 125 - DNA, 20 bp, Artificial Sequence
  Synthetic Primer
atattgggattcctggtcgc

SEQ ID NO: 126 - DNA, 20 bp, Artificial Sequence
  Synthetic Primer
acgacatcaaaggcttgacg

SEQ ID NO: 127 - DNA, 20 bp, Artificial Sequence
  Synthetic Primer
atagccctgaagctgaagcc

SEQ ID NO: 128 - DNA, 20 bp, Artificial Sequence
  Synthetic Primer
cgagtgattgcttggtatcc

SEQ ID NO: 129 - DNA, 20 bp, Artificial Sequence
  Synthetic Primer
aaacgattgagcgggttagc

SEQ ID NO: 130 - DNA, 20 bp, Artificial Sequence
  Synthetic Primer
agagtggttcaatcctctgg

SEQ ID NO: 131 - DNA, 20 bp, Artificial Sequence
  Synthetic Primer
tgtcttggctaatgctgacg

SEQ ID NO: 132 - DNA, 20 bp, Artificial Sequence
  Synthetic Primer
cgagtagttatctggctctg

SEQ ID NO: 133 - DNA, 20 bp, Artificial Sequence
  Synthetic Primer
gtcagttagactctgatgac

SEQ ID NO: 134 - DNA, 20 bp, Artificial Sequence
  Synthetic Primer
cttgaacggtccaacttcac

SEQ ID NO: 135 - DNA, 20 bp, Artificial Sequence
  Synthetic Primer
agttcaggagcttgaatgcg

SEQ ID NO: 136 - DNA, 20 bp, Artificial Sequence
  Synthetic Primer
ttcgcacgcatttatagccg

SEQ ID NO: 137 - DNA, 20 bp, Artificial Sequence
  Synthetic Primer
tcatcttgcgagagcattcg

SEQ ID NO: 138 - DNA, 20 bp, Artificial Sequence
  Synthetic Primer
cttccgctaaatccattacg

SEQ ID NO: 139 - DNA, 20 bp, Artificial Sequence
  Synthetic Primer
agatctatttatccctgcgg

SEQ ID NO: 140 - DNA, 257 bp, Artificial Sequence
  Synthetic Sequence
gctcagcaagagcagaaagacagcgacggtgtagccggttggatcaaggatatgtttggtagtaattaacatctaagcgtgaaataccggatggcgagttgccatccggtaaaataacatcccatctactgcaggctagctaattcttgacatagtttcacagattgtgttataataactacacgacgttcatcgtcgtcaatgtacaggaggtcaacaaatggatttttgcttattgaacgagaaaagtcagatct

SEQ ID NO: 141 - DNA, 5409 bp, Artificial Sequence
  synthetic plasmid pCX027
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctagatctgaattcagctgtacaattggtaccatggatgcatatggcggccgggccctacgtacgcgtgttaaccggtgagctcactagaggatccagccgaccaggctttccacgcccgcgtgccgctccatgtcgttcgcgcggttctcggaaacgcgctgccgcgtttcgtgattgtcacgctcaagcccgtagtcccgttcgagcgtcgcgcagaggtcagcgagggcgcggtaggcccgatacggctcatggatggtgtttcgggtcgggtgaatcttgttgatggcgatatggatgtgcaggttgtcggtgtcgtgatgcacggcactgacgcgctgatgctcggcgaagccaagcccagcgcagatgcggtcctcaatcgcgcgcaacgtctccgcgtcgggcttctctcccgcgcggaagctaaccagcaggtgataggtcttgtcggcctcggaacgggtgttgccgtgctgggtcgccatcacctcggccatgacagcgggcagggtgtttgcctcgcagttcgtgacgcgcacgtgacccaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatccccaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 142 - DNA, 21 bp, Artificial Sequence
  synthetic polylinker
ttaattaagggtttaaactac

SEQ ID NO: 143 - DNA, 28641 bp, Artificial Sequence
  synthetic plasmid pDD61
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcttataccgcagcttctttgaagatttcgtacagacgaaaggcattcttactttttcccctggagattctcatactcacgcggggtgccgcagaagatcacgtcggacttattgatttcggtataatacactttgatcccattggagatcaggtaattgtagatcggcgcaatatacagctcgcccgcatcccagttttcttgcggcaggttcttgtaatgttcatacgcggaaataaagtttttgatcgtgctgaagtggtacagcccggtgcaacacaaattgctaatctgtttcttttcggacgtggcaatcacttcatttttgacgtcattgctgggcatcacgaacgaccagttgtcgccatcgccgcgaaacacttcaatgtaacattcattctcgccctcgaacttggtgaagatgaagttgggacgaatcgtgtcgatgttgaagatggtgatcggctgttcgatattaaacagtttcgagatggccaaatagaccgtctctgcttgaccccgcgtttccttatccagggtgatcagcgtatagctattaatgcccaggctggcgatacgctggagcacgaacgatttcgtgttaaacacgtcacggaggatgaagacaaagtgttccgtctcgaagtacagtttgaagctcttgaggcacaaatcgaacagaaactcgccattcagctccagcatatacttcggtttgctataaccggctttgaaaaagcggctcgacatacctgccatcgggataataatcatactgctgcctccttaaagatttcatacaggcggaaggcattcgcaaacagggcgtcctgccgcttcttgtcgtcgctatgcaacggcagcatcgacaagaacagatgaatttgcatggcgtacagcgacttttcggagatgctgtatttttccttaataatggacacgaaggtcgattggatttcaaagagtttgttatcaatattgattttgaactcaatggaatgggtcttattctttttgttgataatgtagtagcccgcgatgatccagtcatacaggcctagaatggagtgcgacagtttcgcaatatcgtagcggaaatcgccatagatcgagatttcgccgctgtggttcagaccgcgcggatcgaacacctgaatccggcccgtgcggaagttaaagataatattgctgaagcacaggtccccgtgcatgatggtcttgtattgcagttcggacggaatgaatttgttcgtgtcgtacaggatgtcgttgatgctcacgctaatattgttgttaaaattccatttcgcgttcgggtcaatgttgagatcggtgatatacttgctgacgcgctcgatggtcttttcgtaaaacagatcctggagaatgtttttatccgtatcaatgctatgatactctttgcagaggtcgataaaatccaggcagctgatcagaatgttggtcaggatattattcggcaggcgggagaacacgaacagttcgttcagggtggtattgtacaggtattcgagtttgtagcttttgcgaatgtgatcgaacggttccagcaacatcggggtgtagattttcagttcacccggaatcgtctcgaaccatttcgattctgcctcgatcttgctttcattcgaggaggacttaatcacggacttggtcgtgatgcacagctcattgaaggcacgctgggtcgtgtactggactttcgacttatagtaggtattgatgtgaccgaaatcgagccagtcgctgacgtaaatcgacgccaagctgtacgaatcatggtactttttcagggctgccgtgaagtcaaacttgctggtgaccagttcgcgaatgaagaaattgggtttgctgaacgagaagtacccgcagatgacatttttgttgtcctcgcgggagactgcccgcaattccgtctcatagaaaaaggaccactggtagttatcatcggaatgggagatcgccacgaggtcatcacccgccggaatcttcttgaacaaggtatcaccaaacagcagttgcaggcctttatcatctttgtcgccgatcagattccaggccgtgacgattgcctggcccagggtcagattgctatcgaccggaatcatcgtcactttattgcgcagcaaccattcgtaatcgtgtttgtcgaacacgaaatcttccggcaggaccaggtagatcgcatggccatcgtgccccaagctgacctggtgcttgaacagacgcttgtttgccaacggcaggaacgacggcgggatgctaccgaactccgcgcccaattcctgctgcacgtagctaccagacattattagaagcattttttctcctgttctaacatattagagatttcttccaaggtcatattgcacagttccgagggccggatggcccgatcgtccacatagaagccctcgtcgccgcaccacggcttgccgacaatcacctcgtcatacgggacgcggttttcgttcagccagtcgatgatcaccggcagcgtatgaatattgatcttgccaatgttttccttgtacgtccgcatattgcgcgcggtaaagatgacgatgtagaaaccgttcagcttgtactcatagagtttttcgatcaatttcttattgggggttgcatggctgtatttgccgctcagattgaagctaatcgtattatccagatcgacgataattttcttcatttattaacctccttaatataaaccaaggtaagcttttattcccgcaggctcagaatttgctccaggctgattttacgcggggccacaatattcttgatcttcagattgctcactttacagtcgtacacattggcccaggcgcacaagccgacgttgatgtgccccgagtagtacacattcgacgacgagatcaggctcgtcagttgcgagtaaatgttatccagaccatgcacgcacatcagtttcttcatgatgtccgggtcgccatagaacagctgatcgccgatgccaaacccccactcgcgaaaaatccaaccgttgctgtcctcgcaatacacgctgtcgtccacgtcgatatcgttgatggtcacgttatccacttgcagcagggcatcggggcggattttgatgatgcagcggtacttatcccagttatgatttttcagcgagcagaaccaaaaggaattgtggtagtacatcttttccgcgttgctcatcttgttatacggatattcgccatcatccttgatattgatcaggacggagttgcagccggagaagaacgacgagtagatttcttccaggttattgttcttataggaggagagcgacaggtctttcagctcatcataatgttcatccacgaagctgtaattgtcgggttcggacacgtattgggcggcttccgaatcaaaaatgcggcagatgcgttctttgctcagttgcgtatgcccgatatccttccaggtggagataaacacatcgacgtccgacggaatcgtgatcttgctgaccaggttcggcagcgcgtcgatgaaaccgcgcgactgccccgtgatgaacaatgcgatctggcgattggtattcaggctcacattgctgctaatgaaatcatcaatcaccgagatgcgcgatttgatgatacaggaaatgatgccgctatattcgtcggcgtttgccaggacaatttcattgatgtggcacaagaagttgcgctcctgctgcggggtttcgtagaagcgtttgctggtcagggacagtgcgagcagcaacaacttaatcgaattgaaggtgcagccgttcgagttgatcacgagattatacacgtagttggggatgtgcggacggctcatcaggcgcttgaagctggtatcacccaagctggacaggtccgtgttattcttgttgaaacgtttgatgtagaactccggaaagaagaacgcgaagtaaaacgtccctgcgttcgacaacttgttcgggatgataatatactcgaagtattccgacagccacaagtcgaacaactccaggattttgagatgcgcattaaagcctttgccggtcgaaatgttcttgatgcaggacagcgtgcgctcgtccagatggttgacgatgagctgcaccagtttgattttatcttctttcttgctcaggctcaggatgtgatcgaaggtcaagttcttcaacatttattaatcctcctaataagctttgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 144 - DNA, 28640 bp, Artificial Sequence
  synthetic plasmid pDD62
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcttataccgcagcttctttgaagatttcgtacagacgaaaggcattcttactttttcccctggagattctcatactcacgcggggtgccgcagaagatcacgtcggacttattgatttcggtataatacactttgatcccattggagatcaggtaattgtagatcggcgcaatatacagctcgcccgcatcccagttttcttgcggcaggttcttgtaatgttcatacgcggaaataaagtttttgatcgtgctgaagtggtacagcccggtgcaacacaaattgctaatctgtttcttttcggacgtggcaatcacttcatttttgacgtcattgctgggcatcacgaacgaccagttgtcgccatcgccgcgaaacacttcaatgtaacattcattctcgccctcgaacttggtgaagatgaagttgggacgaatcgtgtcgatgttgaagatggtgatcggctgttcgatattaaacagtttcgagatggccaaatagaccgtctctgcttgaccccgcgtttccttatccagggtgatcagcgtatagctattaatgcccaggctggcgatacgctggagcacgaacgatttcgtgttaaacacgtcacggaggatgaagacaaagtgttccgtctcgaagtacagtttgaagctcttgaggcacaaatcgaacagaaactcgccattcagctccagcatatacttcggtttgctataaccggctttgaaaaagcggctcgacatacctgccatcgggataataatcatactgctgcctccttaaagatttcatacaggcggaaggcattcgcaaacagggcgtcctgccgcttcttgtcgtcgctatgcaacggcagcatcgacaagaacagatgaatttgcatggcgtacagcgacttttcggagatgctgtatttttccttaataatggacacgaaggtcgattggatttcaaagagtttgttatcaatattgattttgaactcaatggaatgggtcttattctttttgttgataatgtagtagcccgcgatgatccagtcatacaggcctagaatggagtgcgacagtttcgcaatatcgtagcggaaatcgccatagatcgagatttcgccgctgtggttcagaccgcgcggatcgaacacctgaatccggcccgtgcggaagttaaagataatattgctgaagcacaggtccccgtgcatgatggtcttgtattgcagttcggacggaatgaatttgttcgtgtcgtacaggatgtcgttgatgctcacgctaatattgttgttaaaattccatttcgcgttcgggtcaatgttgagatcggtgatatacttgctgacgcgctcgatggtcttttcgtaaaacagatcctggagaatgtttttatccgtatcaatgctatgatactctttgcagaggtcgataaaatccaggcagctgatcagaatgttggtcaggatattattcggcaggcgggagaacacgaacagttcgttcagggtggtattgtacaggtattcgagtttgtagcttttgcgaatgtgatcgaacggttccagcaacatcggggtgtagattttcagttcacccggaatcgtctcgaaccatttcgattctgcctcgatcttgctttcattcgaggaggacttaatcacggacttggtcgtgatgcacagctcattgaaggcacgctgggtcgtgtactggactttcgacttatagtaggtattgatgtgaccgaaatcgagccagtcgctgacgtaaatcgacgccaagctgtacgaatcatggtactttttcagggctgccgtgaagtcaaacttgctggtgaccagttcgcgaatgaagaaattgggtttgctgaacgagaagtacccgcagatgacatttttgttgtcctcgcgggagactgcccgcaattccgtctcatagaaaaaggaccactggtagttatcatcggaatgggagatcgccacgaggtcatcacccgccggaatcttcttgaacaaggtatcaccaaacagcagttgcaggcctttatcatctttgtcgccgatcagattccaggccgtgacgattgcctggcccagggtcagattgctatcgaccggaatcatcgtcactttattgcgcagcaaccattcgtaatcgtgtttgtcgaacacgaaatcttccggcaggaccaggtagatcgcatggccatcgtgccccaagctgacctggtgcttgaacagacgcttgtttgccaacggcaggaacgacggcgggatgctaccgaactccgcgcccaattcctgctgcacgtagctaccagacattattagaagcattttttctcctgttctaacatattagagatttcttccaaggtcatattgcacagttccgagggccggatggcccgatcgtccacatagaagccctcgtcgccgcaccacggcttgccgacaatcacctcgtcatacgggacgcggttttcgttcagccagtcgatgatcaccggcagcgtatgaatattgatcttgccaatgttttccttgtacgtccgcatattgcgcgcggtaaagatgacgatgtagaaaccgttcagcttgtactcatagagtttttcgatcaatttcttattgggggttgcatggctgtatttgccgctcagattgaagctaatcgtattatccagatcgacgataattttcttcatttattaacctccttaatataaaccaaggtaagcttttattcccgcaggctcagaatttgctccaggctgattttacgcggggccacaatattcttgatcttcagattgctcactttacagtcgtacacattggcccaggcgcacaagccgacgttgatgtgccccgagtagtacacattcgacgacgagatcaggctcgtcagttgcgagtaaatgttatccagaccatgcacgcacatcagtttcttcatgatgtccgggtcgccatagaacagctgatcgccgatgccaaacccccactcgcgaaaaatccaaccgttgctgtcctcgcaatacacgctgtcgtccacgtcgatatcgttgatggtcacgttatccacttgcagcagggcatcggggcggattttgatgatgcagcggtacttatcccagttatgatttttcagcgagcagaaccaaaaggaattgtggtagtacatcttttccgcgttgctcatcttgttatacggatattcgccatcatccttgatattgatcaggacggagttgcagccggagaagaacgacgagtagatttcttccaggttattgttcttataggaggagagcgacaggtctttcagctcatcataatgttcatccacgaagctgtaattgtcgggttcggacacgtattgggcggcttccgaatcaaaaatgcggcagatgcgttctttgctcagttgcgtatgcccgatatccttccaggtggagataaacacatcgacgtccgacggaatcgtgatcttgctgaccaggttcggcagcgcgtcgatgaaaccgcgcgactgccccgtgatgaacaatgcgatctggcgattggtattcaggctcacattgctgctaatgaaatcatcaatcaccgagatgcgcgatttgatgatacaggaaatgatgccgctatattcgtcggcgtttgccaggacaatttcattgatgtggcacaagaagttgcgctcctgctgcggggtttcgtagaagcgtttgctggtcagggacagtgcgagcagcaacaacttaatcgaattgaaggtgcagccgttcgagttgatcacgagattatacacgtagttggggatgtgcggacggctcatcaggcgcttgaagctggtatcacccaagctggacaggtccgtgttattcttgttgaaacgtttgatgtagaactccggaaagaagaacgcgaagtaaaacgtccctgcgttcgacaacttgttcgggatgataatatactcgaagtattccgacagccacaagtcgaacaactccaggattttgagatgcgcattaaagcctttgccggtcgaaatgttcttgatgcaggacagcgtgcgctcgtccagatggttgacgatgagctgcaccagtttgattttatcttctttcttgctcaggctcaggatgtgatcgaaggtcaagttcttcaacatttattaatcctcctaataagctttgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatctgttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 145 - DNA, 16562 bp, Artificial Sequence
  synthetic plasmid pKM010
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctagatctcctaccgaccaggcattggcgcgttccaccatcgtcggcaaatcgcgttcgacagtcaccagaatgctgcgaaagcacgcagtgtcgtccataccgcccgcacggaaatccttgatcgcctgccgcgggttgtcgatcttgtattcgagcgtggtcgaggtcggcttgataccggcgcgcttggcagcgcgctccaccaccgaccagatcaccggcgagcgggccaggccagagcgtttgagcgcagcctgatacaactcgccggcagccagcatcggccgcttgcgctccacgccacggtcgcgccccatgtaacgcgccttggcaacggtccagcgcgcatacaactcaggcggcagcacatcgcgcagctcacgcccgtcttcgttcttcatcgccttcatcgccgcgggcatcagggccaatttgccgaacatgccaacgtcggcatccacctgcaccatcggcgccatcagcacctgctgcgattggccgatgatggtttcgacctcggtcgcttgccactccaggtccttcggcaacggtgacaacgtgcccaggatccacagcacgtggtcgcccttgctgaccttccacaggccggggccgggttgctgcccgcgcaccaccatggcttccagatcgaccaccgttggcggcgctgccggcgcctgtacggccacctcgacggcacacgccagcatcggtgccaacaacgacaccaacgcgattcctgcccgccacaccgcccccctgcgctgcatcacgtaccgcctcccggttggaacgcggacactacgcgaacgcgggcccgcacgcgttagggaagcgttggcggctccggcgcggcgccttcggcaaccaacgcggccagctgtgccgccagcggcgagccgtcttcgagcagcgcgaaaccttcccagacaaaccctggcgaaaccgtgcagcccaccagggtgaagtcccccagcgagcgcgccgcctgccagcagccggccggcaccacgtgcatggcgtcgccgcgctctgcggcgtccagcacttcgcgccgcaactgcccgctcgcttcgtcgaagatcagcaactccagcggcgcaccttgctgccagtgccagcactcctcggcatccacccgatgccagcgactggcttcgcctgcgcacaacaggaagcggatggcggtcagcgccggacgcggcggcgcaccgctgtcatccagcacctggcgcgtcgacgcgtacacgcgccggtagtggccgccctccggatggggggcaaggcccaatgttcgaatcagcgcggcggcggttggatgcatgcacgcatgctaggccacacaccgccgccgtgcatcacgccagctgtttgcccgcacgcaggcaggtgcggaagaacaccagcagatcgcggccgcctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggcgcgccgcggccgccaagacggtattcgggctgcaccgtggacattgccagcgggtccggatgcggcagcgaagacgccatctccgggccggtgctgcaagcgcccagcgacatcgagcagagcagagccaggctgaggccttggcagagtcgtccgatcagtttcttcatgcgtgtagctggctgcctctgttgggtgggacaggacctcgcgcagcattcaaccggctcaggcgccagcacgaacgtacgacaggaagttgcatcccgacgcgtgccgggaccaacgttgaatcgcgtgttgcagtgcactatggcatagaacgaacacatcgcaaggcacaacacgccatttttttgacggcgttggcctattgattcaagttcgtcgcctcgacgttaagagaacgtgacctgggtcgtcattctcagcatacgaactctagcgtttccgggcacttacggacgcctgctgatcccgacttgtagcagcctgaaccgcgaaataattgcgtacaggacttgcatatgccgccttgcaatatgccgttgcgcatagtggcatagcctggaatgccatcgaactgacatgttgcgacgcaacaaaaaggcccacgtcttgcgacgtaggcctgttgtttggtcggggtagccggattcgaaccgacgaccactagtcccccagactagtgcgctaccaggctgcgctataccccgaagatgttgcgtcccgccctgaggcggcctgcgattatagcggctttatgcggcgctttcctagcgtcgcagcagctgcaggacttcttcaagctccatgcgcacctgcttgatgatctgattgctcagcgctgactcgctcttggccccatccccttcaagacgcagacgcgcgcccccgatggtgtaaccctgctcgtacagcaggccacgaatctgccgcaccatcagcacatcgtgccgctggtagtagcgtcggttgccgcgccgcttgactggctccaggctcggaaattcggtttcccaatagcgcagcacgtgcggcttgacgtcgcacagctcgctcacctcaccgatggtgaagtagcgcttggccggaatcggcggtagctcgcgattactgcccggatccagcataagcctccacccgttccttgagtttctggccggggcggaaggtcaccaccgtcctggccgagatcggaatttcctcaccggtcttgggattgcgaccgggccgttggttcttgcgccgcagatcgaagttgccgaagcccgacaacttcacctgacggccctgctccagtgcatcgcgcagcacatcgaaaaacgcgtcgacgaattccttcgcctcacgcttgttcaggccgacttcgtcgaacagacgctcggccatctccgctttcgtcaatgccatgccaatcccctgttaccgccagatctgaattcagctgtacaattggtaccatggatgcatatggcggccgggccctacgtacgcgtgttaaccggtgagctcactagaggatccagccgaccaggctttccacgcccgcgtgccgctccatgtcgttcgcgcggttctcggaaacgcgctgccgcgtttcgtgattgtcacgctcaagcccgtagtcccgttcgagcgtcgcgcagaggtcagcgagggcgcggtaggcccgatacggctcatggatggtgtttcgggtcgggtgaatcttgttgatggcgatatggatgtgcaggttgtcggtgtcgtgatgcacggcactgacgcgctgatgctcggcgaagccaagcccagcgcagatgcggtcctcaatcgcgcgcaacgtctccgcgtcgggcttctctcccgcgcggaagctaaccagcaggtgataggtcttgtcggcctcggaacgggtgttgccgtgctgggtcgccatcacctcggccatgacagcgggcagggtgtttgcctcgcagttcgtgacgcgcacgtgacccaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatccccaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 146 - DNA, 16769 bp, Artificial Sequence
  synthetic plasmid pKM011
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctagatctcctaccgaccaggcattggcgcgttccaccatcgtcggcaaatcgcgttcgacagtcaccagaatgctgcgaaagcacgcagtgtcgtccataccgcccgcacggaaatccttgatcgcctgccgcgggttgtcgatcttgtattcgagcgtggtcgaggtcggcttgataccggcgcgcttggcagcgcgctccaccaccgaccagatcaccggcgagcgggccaggccagagcgtttgagcgcagcctgatacaactcgccggcagccagcatcggccgcttgcgctccacgccacggtcgcgccccatgtaacgcgccttggcaacggtccagcgcgcatacaactcaggcggcagcacatcgcgcagctcacgcccgtcttcgttcttcatcgccttcatcgccgcgggcatcagggccaatttgccgaacatgccaacgtcggcatccacctgcaccatcggcgccatcagcacctgctgcgattggccgatgatggtttcgacctcggtcgcttgccactccaggtccttcggcaacggtgacaacgtgcccaggatccacagcacgtggtcgcccttgctgaccttccacaggccggggccgggttgctgcccgcgcaccaccatggcttccagatcgaccaccgttggcggcgctgccggcgcctgtacggccacctcgacggcacacgccagcatcggtgccaacaacgacaccaacgcgattcctgcccgccacaccgcccccctgcgctgcatcacgtaccgcctcccggttggaacgcggacactacgcgaacgcgggcccgcacgcgttagggaagcgttggcggctccggcgcggcgccttcggcaaccaacgcggccagctgtgccgccagcggcgagccgtcttcgagcagcgcgaaaccttcccagacaaaccctggcgaaaccgtgcagcccaccagggtgaagtcccccagcgagcgcgccgcctgccagcagccggccggcaccacgtgcatggcgtcgccgcgctctgcggcgtccagcacttcgcgccgcaactgcccgctcgcttcgtcgaagatcagcaactccagcggcgcaccttgctgccagtgccagcactcctcggcatccacccgatgccagcgactggcttcgcctgcgcacaacaggaagcggatggcggtcagcgccggacgcggcggcgcaccgctgtcatccagcacctggcgcgtcgacgcgtacacgcgccggtagtggccgccctccggatggggggcaaggcccaatgttcgaatcagcgcggcggcggttggatgcatgcacgcatgctaggccacacaccgccgccgtgcatcacgccagctgtttgcccgcacgcaggcaggtgcggaagaacaccagcagatcgcggccgcctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgccgcggccgccaagacggtattcgggctgcaccgtggacattgccagcgggtccggatgcggcagcgaagacgccatctccgggccggtgctgcaagcgcccagcgacatcgagcagagcagagccaggctgaggccttggcagagtcgtccgatcagtttcttcatgcgtgtagctggctgcctctgttgggtgggacaggacctcgcgcagcattcaaccggctcaggcgccagcacgaacgtacgacaggaagttgcatcccgacgcgtgccgggaccaacgttgaatcgcgtgttgcagtgcactatggcatagaacgaacacatcgcaaggcacaacacgccatttttttgacggcgttggcctattgattcaagttcgtcgcctcgacgttaagagaacgtgacctgggtcgtcattctcagcatacgaactctagcgtttccgggcacttacggacgcctgctgatcccgacttgtagcagcctgaaccgcgaaataattgcgtacaggacttgcatatgccgccttgcaatatgccgttgcgcatagtggcatagcctggaatgccatcgaactgacatgttgcgacgcaacaaaaaggcccacgtcttgcgacgtaggcctgttgtttggtcggggtagccggattcgaaccgacgaccactagtcccccagactagtgcgctaccaggctgcgctataccccgaagatgttgcgtcccgccctgaggcggcctgcgattatagcggctttatgcggcgctttcctagcgtcgcagcagctgcaggacttcttcaagctccatgcgcacctgcttgatgatctgattgctcagcgctgactcgctcttggccccatccccttcaagacgcagacgcgcgcccccgatggtgtaaccctgctcgtacagcaggccacgaatctgccgcaccatcagcacatcgtgccgctggtagtagcgtcggttgccgcgccgcttgactggctccaggctcggaaattcggtttcccaatagcgcagcacgtgcggcttgacgtcgcacagctcgctcacctcaccgatggtgaagtagcgcttggccggaatcggcggtagctcgcgattactgcccggatccagcataagcctccacccgttccttgagtttctggccggggcggaaggtcaccaccgtcctggccgagatcggaatttcctcaccggtcttgggattgcgaccgggccgttggttcttgcgccgcagatcgaagttgccgaagcccgacaacttcacctgacggccctgctccagtgcatcgcgcagcacatcgaaaaacgcgtcgacgaattccttcgcctcacgcttgttcaggccgacttcgtcgaacagacgctcggccatctccgctttcgtcaatgccatgccaatcccctgttaccgccagatctgaattcagctgtacaattggtaccatggatgcatatggcggccgggccctacgtacgcgtgttaaccggtgagctcactagaggatccagccgaccaggctttccacgcccgcgtgccgctccatgtcgttcgcgcggttctcggaaacgcgctgccgcgtttcgtgattgtcacgctcaagcccgtagtcccgttcgagcgtcgcgcagaggtcagcgagggcgcggtaggcccgatacggctcatggatggtgtttcgggtcgggtgaatcttgttgatggcgatatggatgtgcaggttgtcggtgtcgtgatgcacggcactgacgcgctgatgctcggcgaagccaagcccagcgcagatgcggtcctcaatcgcgcgcaacgtctccgcgtcgggcttctctcccgcgcggaagctaaccagcaggtgataggtcttgtcggcctcggaacgggtgttgccgtgctgggtcgccatcacctcggccatgacagcgggcagggtgtttgcctcgcagttcgtgacgcgcacgtgacccaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatccccaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 147 - DNA, 26002 bp, Artificial Sequence
  synthetic plasmid pKM012
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctagatctcctaccgaccaggcattggcgcgttccaccatcgtcggcaaatcgcgttcgacagtcaccagaatgctgcgaaagcacgcagtgtcgtccataccgcccgcacggaaatccttgatcgcctgccgcgggttgtcgatcttgtattcgagcgtggtcgaggtcggcttgataccggcgcgcttggcagcgcgctccaccaccgaccagatcaccggcgagcgggccaggccagagcgtttgagcgcagcctgatacaactcgccggcagccagcatcggccgcttgcgctccacgccacggtcgcgccccatgtaacgcgccttggcaacggtccagcgcgcatacaactcaggcggcagcacatcgcgcagctcacgcccgtcttcgttcttcatcgccttcatcgccgcgggcatcagggccaatttgccgaacatgccaacgtcggcatccacctgcaccatcggcgccatcagcacctgctgcgattggccgatgatggtttcgacctcggtcgcttgccactccaggtccttcggcaacggtgacaacgtgcccaggatccacagcacgtggtcgcccttgctgaccttccacaggccggggccgggttgctgcccgcgcaccaccatggcttccagatcgaccaccgttggcggcgctgccggcgcctgtacggccacctcgacggcacacgccagcatcggtgccaacaacgacaccaacgcgattcctgcccgccacaccgcccccctgcgctgcatcacgtaccgcctcccggttggaacgcggacactacgcgaacgcgggcccgcacgcgttagggaagcgttggcggctccggcgcggcgccttcggcaaccaacgcggccagctgtgccgccagcggcgagccgtcttcgagcagcgcgaaaccttcccagacaaaccctggcgaaaccgtgcagcccaccagggtgaagtcccccagcgagcgcgccgcctgccagcagccggccggcaccacgtgcatggcgtcgccgcgctctgcggcgtccagcacttcgcgccgcaactgcccgctcgcttcgtcgaagatcagcaactccagcggcgcaccttgctgccagtgccagcactcctcggcatccacccgatgccagcgactggcttcgcctgcgcacaacaggaagcggatggcggtcagcgccggacgcggcggcgcaccgctgtcatccagcacctggcgcgtcgacgcgtacacgcgccggtagtggccgccctccggatggggggcaaggcccaatgttcgaatcagcgcggcggcggttggatgcatgcacgcatgctaggccacacaccgccgccgtgcatcacgccagctgtttgcccgcacgcaggcaggtgcggaagaacaccagcagatcgcggccgcctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatctagttacctgcaggcgcgccgcggccgccaagacggtattcgggctgcaccgtggacattgccagcgggtccggatgcggcagcgaagacgccatctccgggccggtgctgcaagcgcccagcgacatcgagcagagcagagccaggctgaggccttggcagagtcgtccgatcagtttcttcatgcgtgtagctggctgcctctgttgggtgggacaggacctcgcgcagcattcaaccggctcaggcgccagcacgaacgtacgacaggaagttgcatcccgacgcgtgccgggaccaacgttgaatcgcgtgttgcagtgcactatggcatagaacgaacacatcgcaaggcacaacacgccatttttttgacggcgttggcctattgattcaagttcgtcgcctcgacgttaagagaacgtgacctgggtcgtcattctcagcatacgaactctagcgtttccgggcacttacggacgcctgctgatcccgacttgtagcagcctgaaccgcgaaataattgcgtacaggacttgcatatgccgccttgcaatatgccgttgcgcatagtggcatagcctggaatgccatcgaactgacatgttgcgacgcaacaaaaaggcccacgtcttgcgacgtaggcctgttgtttggtcggggtagccggattcgaaccgacgaccactagtcccccagactagtgcgctaccaggctgcgctataccccgaagatgttgcgtcccgccctgaggcggcctgcgattatagcggctttatgcggcgctttcctagcgtcgcagcagctgcaggacttcttcaagctccatgcgcacctgcttgatgatctgattgctcagcgctgactcgctcttggccccatccccttcaagacgcagacgcgcgcccccgatggtgtaaccctgctcgtacagcaggccacgaatctgccgcaccatcagcacatcgtgccgctggtagtagcgtcggttgccgcgccgcttgactggctccaggctcggaaattcggtttcccaatagcgcagcacgtgcggcttgacgtcgcacagctcgctcacctcaccgatggtgaagtagcgcttggccggaatcggcggtagctcgcgattactgcccggatccagcataagcctccacccgttccttgagtttctggccggggcggaaggtcaccaccgtcctggccgagatcggaatttcctcaccggtcttgggattgcgaccgggccgttggttcttgcgccgcagatcgaagttgccgaagcccgacaacttcacctgacggccctgctccagtgcatcgcgcagcacatcgaaaaacgcgtcgacgaattccttcgcctcacgcttgttcaggccgacttcgtcgaacagacgctcggccatctccgctttcgtcaatgccatgccaatcccctgttaccgccagatctgaattcagctgtacaattggtaccatggatgcatatggcggccgggccctacgtacgcgtgttaaccggtgagctcactagaggatccagccgaccaggctttccacgcccgcgtgccgctccatgtcgttcgcgcggttctcggaaacgcgctgccgcgtttcgtgattgtcacgctcaagcccgtagtcccgttcgagcgtcgcgcagaggtcagcgagggcgcggtaggcccgatacggctcatggatggtgtttcgggtcgggtgaatcttgttgatggcgatatggatgtgcaggttgtcggtgtcgtgatgcacggcactgacgcgctgatgctcggcgaagccaagcccagcgcagatgcggtcctcaatcgcgcgcaacgtctccgcgtcgggcttctctcccgcgcggaagctaaccagcaggtgataggtcttgtcggcctcggaacgggtgttgccgtgctgggtcgccatcacctcggccatgacagcgggcagggtgtttgcctcgcagttcgtgacgcgcacgtgacccaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatccccaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 148 - DNA, 26209 bp, Artificial Sequence
  synthetic plasmid pKM013
ttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctagatctcctaccgaccaggcattggcgcgttccaccatcgtcggcaaatcgcgttcgacagtcaccagaatgctgcgaaagcacgcagtgtcgtccataccgcccgcacggaaatccttgatcgcctgccgcgggttgtcgatcttgtattcgagcgtggtcgaggtcggcttgataccggcgcgcttggcagcgcgctccaccaccgaccagatcaccggcgagcgggccaggccagagcgtttgagcgcagcctgatacaactcgccggcagccagcatcggccgcttgcgctccacgccacggtcgcgccccatgtaacgcgccttggcaacggtccagcgcgcatacaactcaggcggcagcacatcgcgcagctcacgcccgtcttcgttcttcatcgccttcatcgccgcgggcatcagggccaatttgccgaacatgccaacgtcggcatccacctgcaccatcggcgccatcagcacctgctgcgattggccgatgatggtttcgacctcggtcgcttgccactccaggtccttcggcaacggtgacaacgtgcccaggatccacagcacgtggtcgcccttgctgaccttccacaggccggggccgggttgctgcccgcgcaccaccatggcttccagatcgaccaccgttggcggcgctgccggcgcctgtacggccacctcgacggcacacgccagcatcggtgccaacaacgacaccaacgcgattcctgcccgccacaccgcccccctgcgctgcatcacgtaccgcctcccggttggaacgcggacactacgcgaacgcgggcccgcacgcgttagggaagcgttggcggctccggcgcggcgccttcggcaaccaacgcggccagctgtgccgccagcggcgagccgtcttcgagcagcgcgaaaccttcccagacaaaccctggcgaaaccgtgcagcccaccagggtgaagtcccccagcgagcgcgccgcctgccagcagccggccggcaccacgtgcatggcgtcgccgcgctctgcggcgtccagcacttcgcgccgcaactgcccgctcgcttcgtcgaagatcagcaactccagcggcgcaccttgctgccagtgccagcactcctcggcatccacccgatgccagcgactggcttcgcctgcgcacaacaggaagcggatggcggtcagcgccggacgcggcggcgcaccgctgtcatccagcacctggcgcgtcgacgcgtacacgcgccggtagtggccgccctccggatggggggcaaggcccaatgttcgaatcagcgcggcggcggttggatgcatgcacgcatgctaggccacacaccgccgccgtgcatcacgccagctgtttgcccgcacgcaggcaggtgcggaagaacaccagcagatcgcggccgcctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgtttaaacagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgccgcggccgccaagacggtattcgggctgcaccgtggacattgccagcgggtccggatgcggcagcgaagacgccatctccgggccggtgctgcaagcgcccagcgacatcgagcagagcagagccaggctgaggccttggcagagtcgtccgatcagtttcttcatgcgtgtagctggctgcctctgttgggtgggacaggacctcgcgcagcattcaaccggctcaggcgccagcacgaacgtacgacaggaagttgcatcccgacgcgtgccgggaccaacgttgaatcgcgtgttgcagtgcactatggcatagaacgaacacatcgcaaggcacaacacgccatttttttgacggcgttggcctattgattcaagttcgtcgcctcgacgttaagagaacgtgacctgggtcgtcattctcagcatacgaactctagcgtttccgggcacttacggacgcctgctgatcccgacttgtagcagcctgaaccgcgaaataattgcgtacaggacttgcatatgccgccttgcaatatgccgttgcgcatagtggcatagcctggaatgccatcgaactgacatgttgcgacgcaacaaaaaggcccacgtcttgcgacgtaggcctgttgtttggtcggggtagccggattcgaaccgacgaccactagtcccccagactagtgcgctaccaggctgcgctataccccgaagatgttgcgtcccgccctgaggcggcctgcgattatagcggctttatgcggcgctttcctagcgtcgcagcagctgcaggacttcttcaagctccatgcgcacctgcttgatgatctgattgctcagcgctgactcgctcttggccccatccccttcaagacgcagacgcgcgcccccgatggtgtaaccctgctcgtacagcaggccacgaatctgccgcaccatcagcacatcgtgccgctggtagtagcgtcggttgccgcgccgcttgactggctccaggctcggaaattcggtttcccaatagcgcagcacgtgcggcttgacgtcgcacagctcgctcacctcaccgatggtgaagtagcgcttggccggaatcggcggtagctcgcgattactgcccggatccagcataagcctccacccgttccttgagtttctggccggggcggaaggtcaccaccgtcctggccgagatcggaatttcctcaccggtcttgggattgcgaccgggccgttggttcttgcgccgcagatcgaagttgccgaagcccgacaacttcacctgacggccctgctccagtgcatcgcgcagcacatcgaaaaacgcgtcgacgaattccttcgcctcacgcttgttcaggccgacttcgtcgaacagacgctcggccatctccgctttcgtcaatgccatgccaatcccctgttaccgccagatctgaattcagctgtacaattggtaccatggatgcatatggcggccgggccctacgtacgcgtgttaaccggtgagctcactagaggatccagccgaccaggctttccacgcccgcgtgccgctccatgtcgttcgcgcggttctcggaaacgcgctgccgcgtttcgtgattgtcacgctcaagcccgtagtcccgttcgagcgtcgcgcagaggtcagcgagggcgcggtaggcccgatacggctcatggatggtgtttcgggtcgggtgaatcttgttgatggcgatatggatgtgcaggttgtcggtgtcgtgatgcacggcactgacgcgctgatgctcggcgaagccaagcccagcgcagatgcggtcctcaatcgcgcgcaacgtctccgcgtcgggcttctctcccgcgcggaagctaaccagcaggtgataggtcttgtcggcctcggaacgggtgttgccgtgctgggtcgccatcacctcggccatgacagcgggcagggtgtttgcctcgcagttcgtgacgcgcacgtgacccaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgctgcttccctgctgttttgtggaatatctaccgactggaaacaggcaaatgcaggaaattactgaactgaggggacaggcgagagacgatgccaaagagctacaccgacgagctggccgagtgggttgaatcccgcgcggccaagaagcgccggcgtgatgaggctgcggttgcgttcctggcggtgagggcggatgtcgaggcggcgttagcgtccggctatgcgctcgtcaccatttgggagcacatgcgggaaacggggaaggtcaagttctcctacgagacgttccgctcgcacgccaggcggcacatcaaggccaagcccgccgatgtgcccgcaccgcaggccaaggctgcggaacccgcgccggcacccaagacgccggagccacggcggccgaagcaggggggcaaggctgaaaagccggcccccgctgcggccccgaccggcttcaccttcaacccaacaccggacaaaaaggatccccaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcactggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacag

SEQ ID NO: 149 - DNA, 23013 bp, Artificial Sequence
  synthetic plasmid pCX096
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccaatctagattgtttaaacttctgcagaacacgcggtgttaacgtttcttatacttcttaattttgttaaagatcatttcgccgtagtacaccgcattgacctgggtcttcaccagcaagtagccgcgaaatttcttaaacaacttcatgttcggtttaaagtcggcttgccagaactgatgcaaatgcccctggtacgtcagacccttgatatcgtacaaggcgttgcccatgactttcaggggcttgttgtggatcaacgcggaaatgccggccgtgctattgatggtgaccaccgctttggcgtggcgcaacagctccggcatgggcagatcgtgcacatagatgacacgttcatccaaaccgtattccttcgacagacgcttgatcaacgggcggtacaggcggtgcccgcgatccatcgggtgatgtttgatcaccagataggactccttgggggccttgcgggaaaagctgtacatcacttcgttgatgtaatcacgcacatcattatagttgctatggttgcggatctggctgtcgttgtacacttgcaggaccgccaggtaatagcgctgatccagctcgttcatcaggcgggggaggaccttgcgttgggtgaccttatacagctgtttgcgccagtaggcgcggacccagcagcgcgcttcataccacgggctgaacgatttgtggtggcgatagcgcggaaattcgtgacgatagtgccaacccatcaggtaataccacatggcgtggccgatgcgcttcatggtgctcggtttcaggttctcgacgtgcggcgtcggcatatcgggcaatttgcggtaaaagtccggatcgcggggcaagctgctataggcgttcacaccgccttcttccacggtgataaattgcggacgcaggtagccttcctcgaaggccagaaaacgaatccccttcgacttggcccagcgtttggcctccttgtgcagcaggcggcagtcaccgaaacacaaaatcgtgtcaaagtcatactgacgatgcaagtcccgcagccaaccggggaactccttcggggtttggtagtacgccaggtattggcggtggcggcagtagaagcgatcaccgccattaaagacgacgttgaccgcgttgcgaccgaggctctccaaccattccgccacatcgttgaagaacggacccatcggaccttggagcaggaggtactttttaccgctcaacagcaccgtcagcgcattgccgtgcatttattaacctcctaacacgcggtgttaagcgttttcggcgagctcttaaccaaagcgcactttgcagaacatgatcaacttgcgatagtagcgaatcacacggccggctttcttgcgggtgataaagatgggtttgcggggcgttttgatcagatattctgccgcttcctccaccgtgatcggctgcaaccgcgtcggatgaatataggtgggatagacaatcagggcttgatagatcaggtcggcgatggtcagccgccgctcgcgacgggggcagtggtgctcatcgacggtcaggccccacgaggcgtagaacggcaggccgtagcagtgcacctgtttaccgtgcagcaatgcttcaaagccgctgaggctcgtcatcgtgtgcacctcgtccgcacgctgaatacactgaatgatatcggcatccagtgcctggtagtctgcgagttccgcgatctgttccgccggaatgtcacccttacggttgccgacgagcacatcggggtgcggcttgtagatgatgtaggcgtgcggattacgttcccgcacggtgcgcagcagctccagattcgacttgatcgacacggtgcccgtcttaatcgacgcatcgtcttccacctggcccggcaccaggatgactttcttgtccttcgcttctgccgggaggctgaaatcggcccccaggttatatttgctcaatttgctttccaccagacgttggcgcaacttttccgcgcgcatctggtgcgcgagggtcagctggctgtgattcagcaggacctccagttccgacggacgggtggcatcgtaatagataccgcgcttatccaggaccaggctcaacggcggcagcagatcgctccccaggccggagctgcgcaggaagccgtcttccatgcgccacagcggcagggatttgcgctgtgcctccgcacgccattgctgttcgcctttcacgccccacacgacgcaggcgcttgctgcggtacagcgacgggaaaaggagagacgattcgtggccgtttgcaggaagggcttcaggatcgcgcttttccacagggtcaggcccggcacccagagataaccattccgctgttgcaggtgacgacgttgcagctggagccattggagcaccgtgaacagggccgacacctccccggtctgcggatcaatgtagcggcaatagcgcagataggccgctgcgaacagttcctccagggtggccgagccgcgacgcgccgacagcagcgccgattgggggtggcggtcatcggtgaggccccaccctgcataccagggttggccaaagcaggtcacgggcttaccggccagcagggcttcaaaaccgtactgggaggtcacgacgtacacgcgggacacatgacgcagcagggactgcggcgacacgttttccgcaatcaggcgcacgcgctgggtggcacgcaagtccgcgaagtagccggtctttttcccttccaggacatcgggatgcactttgacccagatttctgcctgcgggttttccgccatcgctgcttccagcattgcggcgaactcatgggggcctgcgttgccgtaggtcacgctcatgtcattgaaggtctggtccaccaccagcacgatgttcgtgcgctcgctttcatccgccacgaacgccggtgccaggttgtacttgctcatgtcgcccgtcacaatggtgtgcatcgcctcgcgcgcctgatccgccagggccgcgttgccggccttgtcctgcacgagtttttccagcgcgctcggtttcgaggcgtcgtagtaaatgccgcagtcatccacgacgagcgagaggggcggttcaccgttcacgcccaggtccagcgagcggacgaaaccatcctccaagcggatcaccggcttgcctgcggctttggcgatggccaccggctttgcggccgaggggcggtgcccccacaccgcgattgcatccacttcctgcgggaccgggcgcagcagcgacagcttttggcagggctgggcgaggaatttttccaggtgcggaatacgccaaatgccggggctataaatgccaatcatgcgttctccgcgagctcctgcgccatcagggcccggaccttctccaagcacgccggggtatcgacgccgggaccggtcgcggcgacctcgaaggtgcgaatgttaatgcccgcgctcatcagccgcagttgctccagggattcggcctgttcgggcatggactccggcaactggctgtaattttgcaggacatcccgccgataggcgtagatcccgacgtgcttcaggtagcgcgccttctcggcgttgcgcgggtacggaatgggggagcgggagaaatacagggcgtcctgccgcgtgttcaccacgaccttgacggtggacggttcggcggcttctgccgcgctgatcgcatgacacagggtcgccaccggcagcgccgggtcgtcccgcataccttgcagcagggtttcgacgtcacgcgggcgaatcatcggctcatccccttgcaggttgatatagatatccgcctccaccttatgcatgacttccaccaggcgatcggtgccgctctcatgatcgttgcgggtcatgatcgctttgccgccgaacgcctggactgcctgctccacacgcgggtcgtcggttgcgacccacacctctgccacgcctgccacttgcagggcccgttcgtagacgtgctggatcatcggtttcccgacgatatccagcagcggtttgcccggcagacggctgctgccgtagcgtgccgggatcacaatcacggccttcgacatttattaacctcctcgagttacagcgacagaatcactttcgcgcccaccgccagttggtacagaatggtgctgataccgcgcgtcacttcgatgttcttcgactcgtatttcggcaacaccataatttcatcaccgggtttcagggaatcgacgtcttctgcgttcaccgctgcgccgttctgacggatgacgataatacgggcgttgccggacttctgggtcagcccaccgcacttctcgatgtagtcctcggtcgtcatacctttctgccacgacaccgcgttcgggaacagcacttccccgtggaccatgaccaacgacgtcttttcgggaatattgatcacgtcgccgtcctccaggaggacggagtcaatgttgctttcattgaggatcacttcgcccttcggcacgacggtgcgggctttcgcgacgaagcgggagatcagttgggcttcctgcatacgcaggctggcctcttccttggtgctgctctgtgcgctgaggctggcctcttcgagcttttgcagggacaaattcagcatttctttctgccgttgcgcgacgctcggccgatacaactgcacggcgttcatctgcgacatggagttcgggcgcactttttcgagcacggcccgcatggtgctaccgtagggcagcaccatggcgtgttccccggaatgtgcgccttccacacgcacttgaatggtgcccgcatagcggtcggtggagacaatgagggtatcaccgttttgcagcatacgccccggtgcggacgagatcggataatattccgagcgcttctggaggccctgcttccgcataatcgtgatatgggtcgcacccggtttgggacgtgcccaggacagtgcttcggtgaccgggatgctcgattcgcgaaattcaaagtcgtaggaattgaacacatcgccctgcaccgagaacgtatgctggcgcggacccacaatgatcgtatcaccgtccgcaaactgggacagccccagtttgccgttgagcaggaagtcatagaggttgacgttcgagcgcacacgattgccgcgtttcacgacgatgtccacgtagctgccgcgttccgggtccacaccacccgccttgatcaggtagttcagcaggctgtcggaggtgacaccgccgtacaggccggggttgcggacaaagccggtcacatagaccttgaccggctgcgcctgcaagagcgacgcatagacgttcacgttgctctggtagacttccttcaccttgctcgtcaccagcgcgttcaactgggagttcgacacacctgcgactttgacggggccgacattcggcaggaagatgttgcccttcgggtccacctggagtgcgccatcgaaggtgaacgcaccccacaggcggacctggatggaatcgccgggattcaggatgtagtccggattgaaacccacggttgcccccgagtctgcgctcgtaccgttgaacagctgcgccccgaacatacggctcatcacgaccgggggtgcggggggcggggtgttatcgaagccgctcatgttctgggtgtcgcttttctgcccgttcaggatgccggtcaacggtgcggcacccgtgaggttcggatcggcattaatgtcgatggttgcgctcgcctgtgctgcatggcacgctgcgatcagcaggatcgacttaaacagcttcatttattaacctcctcgagaagtcgacttagtcacggtggtcttcaatcaccgccaggagcaatttcagggtgccaaagagcaggcaacacaccagcagccaacacgcgatcaaatacgggatattcgggaaggagctttcctggggcagctgcggggacgagatcacgctcaggactttcagcttacgggccgcttcgacacgggtcttttcgatgctggtgagcgtgagcttgtacaactcggtattgaactcgaccttggatttgatctcctcaaaatccacggccatgcggttcagtttatcgccctggggtgcggtaattttcgacttttcttcgtcgatctgtgcctggaggctctgaattgcattgcgggcgctcacgacttggggcgcatcctcgcgcaggtacgtgagcaggttgcgcaggtcggcttccatctgaattttctggcccatcagcgtattcaccagggtggatgccgcctgggcctgtgcctgcgggtccagcacattgttgttgtcttggtaggacaacaattcggctttcgatgcatccagccgctggcgcgctttttccatttcggtttccgcaaacgccaattgatcgcgggcgatacggtgcgacatttcattgatgaaccgctcggattccttgagcacggtctggttgaatttcagcgcgaactcgggcgaaaagccctgggtctggatgttcagcagcccggtcttgtcgtcgtagctgacgttgatgcgatctttatagtacttcaggaacccctcggcggtttcatccttggacagatggttcaggaagtccaggcccgaatgggagaacgcttcgcggaagttcagctgtttatccagcgcggccagcatatccgggctgttgatgtattccttcaggtacagtgcgtcttcggcggacgacgggttggaggcacccaacagcaggccgaagttcaggctgccggagttgagatcgtcgctgcgcttgatggccaccttgctttccgacatatagcggggctgggagaagatcgccaagtagatcagcagcaccgccatgggtgccagaataatgatttttgccaggtgcttctgaatatctgccaggctgatcgcgctcagacgcgcacgcatccacgagacggcgcttttcactttgatcagcatttattaacctcctgtcgacaacacgtgttaatcgaaaatgcgcaccaacccggtcaccttatttgctttgttggtcaccagcagggtcgagacgcggtgtttctgcatcttctcttctgcttcgatgatcatggtgtcttcgggcaaggtcagcggttcgcgggtcatcatctgtgcggccgttgcgctcgtcaggctgtcttctttctccataaagcgccgcagatcgccatcggtgatgatgcctgccagcccaccttccgcatcttcgaccatcaccataccctggcagcccgaggtgatgcgctgaatgaccgttttgaagctggcatcgagctgcactgccggcacatcatgttgcatcacgtcggcgacgcgggtcagcaggcgccgacccaggctgccaccggggtggtagcgtgcaaagtcattgggcataaacttacgctggtgaatcatcgcgatggccagcgcgtccccgatcgccatcgtgagcgtcgtggaggtggtcggggcgagattgttcgggcacgtttcgttcgccatgtgcagctccaggaccgcatctgcatttttggccagggtgctattcccgttattggtgattgcgatgatgcgattgccgaagttcttcaggctcggcaccagtttcaggatctcgtccgtctcaccgctcgccgaaatcaagatgagcaggtcatacggggtgatcatgcccagatcaccatggaacgcttccgccggatgaataaagaaggagggcgtcccggtcgaggccaaggtcgccgacatcttgcggcccacatggccgcttttacccatgccgctcaggatgacgtgccctttacaattcatgatgagattcaggacgcgctggtactgaccgctatccagttgtttggacaggttttgcagtgccgcgctttgttcggccagggtctggcggacgctcgtaatcagatacggatcaatggtcgaggactggtcatccggcaagtggcgttcgctcatttattaacctcctcacgtgttaattaatgtttctgttgcataaagcctaaggggtaggcctttctagagatagccattttttgcactcctgtatccgcttcttgcaaggctggacttatccctatcaaaccggacactgcatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 150 - DNA, 16462 bp, Artificial Sequence
  synthetic plasmid pCX101
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcgtttagtagttgttttgttcggtgatatattcttcaatgccttcttgcacgtcttcatggaacgacacggcgttgtcgtctttaaacacgattgccacatcgcagaactctttcaacgagttcagcgagtgcgacaccatgaggaaggagctttccttatgacgctccttgaagagttgggcacatttttccttgaaacgggcgtcccccaccgccgtcacctcgtccacgatgtagtaatcgaacttgaacgccatgctcaggccgaagccgaggcggctgcgcataccgctcgaataggtcttgatcggcatatcaaaatacttccccagctccgcgaactcttccacaaactcaatcttttctttcagctcctcctgcttcgcgtacagccgggccacgaacttcacgttttcacgcccggtcaagctgccctggaagccgcctgccagacccaccggccacgagatcgttttattcgtgatgattttaccgctatccgggcggtcgatgcccccaatcatgcgcaacagcgtggatttacccgccccattgcgcccgatgaacgccacgcttttgccgctggggatctcaatgttcaggttcttgaagacatagtgacggcccaccggggtgcggtagcttttcgtcaggttttcgatcttaatcatgaggtcaacattgcctcctcacgcgtacggtacagggccaaaccaataaacagggtcaccagggtgaacattgccagataattcaggctgaccccttcgctgatataaccgggcatcacggcctcgcggctcagttcgacgacgtgcaccaggggattccacagcaggtacgaccaatactgcttcggaatggagtgcagcgggaacatgatgcacgaaataaagtacagcggcttcagcaagatcggcaagactttctgcatttcggggaacgtcttgcccacgaccatgaagatcaggcccacaccgcacgacaggatgatcaggaggctccaggtgagcacaaattgcaggaagttggtaatctcgaaatattcgcccgccatccagatgatcagcatcaggaggatgtagaccgccacatagatcagcgtttccaagagggcgcgtgcaatgatcgtgtcgatcggcttcacgggccggtagttaaacagcccctgattggcttcgatggcgcccacggagcgattgctgatgctgctgaaaataaagaacgggatcaggccattgagcaggaacaccgggaaggagatatccggcatggtgcgatgcatgatatagccaaagatcccgagcagaatcagcagatgtgcgctcggttccaggatcgcccacagatagcccaggcgaaacttgccaaagcgcgtacggatttcgcggagaaacagtgcttcgaccgtcactttctggacttcaaaacccgaacgtgccatttattaacctcctggtaccaatctagattgttttaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatacttattcaggcgtagcaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 151 - DNA, 13809 bp, Artificial Sequence
  synthetic plasmid pCX081
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 152 - DNA, 13956 bp, Artificial Sequence
  synthetic plasmid pCX082
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 153 - DNA, 12916 bp, Artificial Sequence
  synthetic plasmid pCX075
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 154 - DNA, 13510 bp, Artificial Sequence
  synthetic plasmid pCX092
ctcgggccgtctcttgggcttgatcggccttcttgcgcatctcacgcgctcctgcggcggcctgtagggcaggctcatacccctgccgaaccgcttttgtcagccggtcggccacggcttccggcgtctcaacgcgctttgagattcccagcttttcggccaatccctgcggtgcataggcgcgtggctcgaccgcttgcgggctgatggtgacgtggcccactggtggccgctccagggcctcgtagaacgcctgaatgcgcgtgtgacgtgccttgctgccctcgatgccccgttgcagccctagatcggccacagcggccgcaaacgtggtctggtcgcgggtcatctgcgctttgttgccgatgaactccttggccgacagcctgccgtcctgcgtcagcggcaccacgaacgcggtcatgtgcgggctggtttcgtcacggtggatgctggccgtcacgatgcgatccgccccgtacttgtccgccagccacttgtgcgccttctcgaagaacgccgcctgctgttcttggctggccgacttccaccattccgggctggccgtcatgacgtactcgaccgccaacacagcgtccttgcgccgcttctctggcagcaactcgcgcagtcggcccatcgcttcatcggtgctgctggccgcccagtgctcgttctctggcgtcctgctggcgtcagcgttgggcgtctcgcgctcgcggtaggcgtgcttgagactggccgccacgttgcccattttcgccagcttcttgcatcgcatgatcgcgtatgccgccatgcctgcccctcccttttggtgtccaaccggctcgacgggggcagcgcaaggcggtgcctccggcgggccactcaatgcttgagtatactcactagactttgcttcgcaaagtcgtgaccgcctacggcggctgcggcgccctacgggcttgctctccgggcttcgccctgcgcggtcgctgcgctcccttgccagcccgtggatatgtggacgatggccgcgagcggccaccggctggctcgcttcgctcggcccgtggacaaccctgctggacaagctgatggacaggctgcgcctgcccacgagcttgaccacagggattgcccaccggctacccagccttcgaccacatacccaccggctccaactgcgcggcctgcggccttgccccatcaatttttttaattttctctggggaaaagcctccggcctgcggcctgcgcgcttcgcttgccggttggacaccaagtggaaggcgggtcaaggctcgcgcagcgaccgcgcagcggcttggccttgacgcgcctggaacgacccaagcctatgcgagtgggggcagtcgaaggcgaagcccgcccgcctgccccccgagacctgcagatccacatccttgaaggccgcagcgacgagcagaaggaaaccctcattcgggaagtcagcgaggccatctcgcgctccctggatgcgccgctgaccagcgtgcgagtgattatcacggagatggccaagggccacttcggcatcggcggcgaactggccagcaaggtcagacgctgaagtggagatgcccaagggcacttcgggtcgaggaacccgacctgcattgggacgcggccacggagagcgcgggcaaacgccggcactatagccagtggagtttgtaaaacgctatttcagagcttggagagtgtctaagaaagccggggcgatgccaacccatcccttcttcggctatgcatcgttcgtaatcaagccacttcctttttgcattgacgcagggtgtcggaaggcaactcgccgaacgcgctcctatagttttcagcgaagcgtcccaaatgtaagaagccgtagtctagggctatctcagttatactacgcacattggcactgggatcgttcaagcaggcgcggatgctttcgagcttgcggttgcggatgtagttcttcggcgtggtgccggcatgcttctcgaacaaattgtagagcgagcgtggactcatcatcgccagctccgctaaccgctcaaggctgatattccgtttgagattctcctcaatgaattgaacgactcgctcgaaagacgggttacctttgctgaaaatttcacggctgacattgctgcccagcatttcgagcagcttggaagcgatgatccccgcatagtgctcttggacccgaggcatcgactttgtatgttccgcttcgtcacaaactaacccgagtagattgataaagccatcgagttgctggagattgtgtcgcgcggcgaaacggataccctccctcggcttgtgccaattgttgtcactgcatgcccgatcaaggaccactgagggcaatttaacgataaatttctcgcaatcttctgaataggtcaggtcggcttggtcatccggattgagcagcaatagttcgcccggcgcaaaatagtgctcctggccatggccacgccacaggcaatggcctttgagtattatttgcagatgataacaggtctctaatccaggcgagattaccctcacgctaccgccgtagctgattcgacacaggtcgaggcatccgaagattctgtggtgcagcctgcctgccgggcgcccgcccttgggcaggcgaatagagtgcgtaccgacatactggttaacataatcggagactgcatagggctcggcgtggacgaagatctgacttttctcgttcaataagcaaaaatccatagttcacggttctcttattttaatgtgggctgcttggtgtgatgtagaaaggcgccaagtcgatgaaaatgcatctcgacgtgatgcgtatacgggttacccccattgccacgttgcgccatcctttttgcaatcagtgaccacttttccaagcaaaaataacgccaagcagaacgaagacgttctttttaagaagcgagaacaccagaagttcgtgctgtcggggcatgcggcgacgaattggcggataaaggggatctgcaggtcccgagcctcacggcggcgagtgcgggggttccaagggggcagcgccaccttgggcaaggccgaaggccgcgcagtcgatcaacaagccccggaggggccactttttgccggagggggagccgcgccgaaggcgtgggggaaccccgcaggggtgcccttctttgggcaccaaagaactagatatagggcgaaatgcgaaagacttaaaaatcaacaacttaaaaaaggggggtacgcaacagctcattgcggcaccccccgcaatagctcattgcgtaggttaaagaaaatctgtaattgactgccacttttacgcaacgcataattgttgtcgcgctgccgaaaagttgcagctgattgcgcatggtgccgcaaccgtgcggcaccctaccgcatggagataagcatggccacgcagtccagagaaatcggcattcaagccaagaacaagcccggtcactgggtgcaaacggaacgcaaagcgcatgaggcgtgggccgggcttattgcgaggaaacccacggcggcaatgctgctgcatcacctcgtggcgcagatgggccaccagaacgccgtggtggtcagccagaagacactttccaagctcatcggacgttctttgcggacggtccaatacgcagtcaaggacttggtggccgagcgctggatctccgtcgtgaagctcaacggccccggcaccgtgtcggcctacgtggtcaatgaccgcgtggcgtggggccagccccgcgaccagttgcgcctgtcggtgttcagtgccgccgtggtggttgatcacgacgaccaggacgaatcgctgttggggcatggcgacctgcgccgcatcccgaccctgtatccgggcgagcagcaactaccgaccggccccggcgaggagccgcccagccagcccggcattccgggcatggaaccagacctgccagccttgaccgaaacggaggaatgggaacggcgcgggcagcagcgcctgccgatgcccgatgagccgtgttttctggacgatggcgagccgttggagccgccgacacgggtcacgctgccgcgccggtagcacttgggttgcgcagcaacccgtaagtgcgctgttccagactatcggctgtagccgcctcgccgccctataccttgtctgcctccccgcgttgcgtcgcggtgcatggagccgggccacctcgacctgaatggaagccggcggcacctcgctaacggattcaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgactatcggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtacaagatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagccgagcgatgataagctgtcaaacatgagatccgataaatcgattgatagatttaaataagaactgcagaagctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaagtaatcgatagtgatttaaatatgcaagatctagttacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtggcgcgcctaagtcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagggcctcgtgatacgcctatttttataggttaatgtcatgataataatggtttcttagacgtcaggtggcacttttcggggaaatgtgcgcgcccgcgttcctgctggcgctgggcctgtttctggcgctggacttcccgctgttccgtcagcagcttttcgcccacggccttgatgatcgcggcggccttggcctgcatatcccgattcaacggccccagggcgtccagaacgggcttcaggcgctcccgaaggt

SEQ ID NO: 155 - DNA, 56 bp, Artificial Sequence
  synthetic primer DHD266c
tagcggccgcatactcgagcatggcgcgcctaacgtcgactaagatctctaagctt

SEQ ID NO: 156 - DNA, 56 bp, Artificial Sequence
  synthetic primer DHD267c
cgaagcttagagatcttagtcgacgttaggcgcgccatgctcgagtatgcggccgc

SEQ ID NO: 157 - DNA, 5243 bp, Artificial Sequence
  synthetic plasmid pMAK705pI
gatccccgacagtaagacgggtaagcctgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcatttaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcgaacttttgctgagttgaaggatcagatcacgcatcctcccgacaacacagaccattccgtggcaaagcaaaagttcagaatcaccaactggtccacctacaacaaagctctcatcaaccgtggctccctcactttctggctggatgatgaggcgattcaggcctggtatgagtcggcaacaccttcatcacgaggaaggccccagcgctattctgatctcgccatcaccaccgttctggtgattaaacgcgtattccggctgaccctgcgggctgcgcagggttttattgattccatttttgccctgatgaacgttccgttgcgctgcccggattacaccagtgtcagtaagcgggcaaagtcggttaatgtcagtttcaaaacgtccacccggggtgaaatcgcacacctggtgattgattccaccgggctgaaggtctttggtgaaggcgaatggaaagtcagaaagcacggcaaagagcgccgtcgtatctggcgaaagttgcatcttgctgtggggatcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccatgtttgacagcttatcatcgaagcttagagatcttagtcgacgttaggcgcgccatgctcgagtatgcggccgctaatgaatcggccaacgcgcggggagaggcggtttgcgtattggcaccattccttgcggcggcggtgctcaacggcctcaacctactactgggctgcttcctaatgcaggagtcgcataagggagagcgtc

SEQ ID NO: 158 - DNA, 25 bp, Artificial Sequence
  synthetic primer DHD280c
catatggcggccgctaataagcaga

SEQ ID NO: 159 - DNA, 58 bp, Artificial Sequence
  synthetic primer DHD281c
ttagatcttagtcgacgttaggcgcgccatgctcgagtaatggtattgaccagcatgg

SEQ ID NO: 160 - DNA, 55 bp, Artificial Sequence
  synthetic primer DHD283
cgagcatggcgcgcctaacgtcgactaagatctaagagctgttcctgagtgaagc

SEQ ID NO: 161 - DNA, 32 bp, Artificial Sequence
  synthetic primer DHD285
ttcgaaaagcttttcgcaatgtaaccagccag

SEQ ID NO: 162 - DNA, 40 bp, Artificial Sequence
  synthetic primer DHD268c
catatggcggccgctaataaacgggttgttactcgctcac

SEQ ID NO: 163 - DNA, 57 bp, Artificial Sequence
  synthetic primer DHD269c
ttagatcttagtcgacgttaggcgcgccatgctcgagcttcatccaccacatacagg

SEQ ID NO: 164 - DNA, 57 bp, Artificial Sequence
  synthetic primer DHD271
ctcgagcatggcgcgcctaacgtcgactaagatctaagtgccaatgaatcgtctgac

SEQ ID NO: 165 - DNA, 32 bp, Artificial Sequence
  synthetic primer DHD273
ttcgaaaagctttccatttcgctggtggtcag

SEQ ID NO: 166 - DNA, 40 bp, Artificial Sequence
  synthetic primer DHD274c
catatggcggccgctaataaattccaacagggtggttacc

SEQ ID NO: 167 - DNA, 58 bp, Artificial Sequence
  synthetic primer DHD275c
ttagatcttagtcgacgttaggcgcgccatgctcgagcagtacagcaaggatagaacc

SEQ ID NO: 168 - DNA, 57 bp, Artificial Sequence
  synthetic primer DHD277
ctcgagcatggcgcgcctaacgtcgactaagatctaagcgatgacaccaaaaggtgc

SEQ ID NO: 169 - DNA, 32 bp, Artificial Sequence
  synthetic primer DHD279
ttcgaaaagcttagactcacccagataagtcg

SEQ ID NO: 170 - DNA, 14823 bp, Artificial Sequence
  synthetic plasmid pBR1102
gatccccgacagtaagacgggtaagcctgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcatttaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcgaacttttgctgagttgaaggatcagatcacgcatcctcccgacaacacagaccattccgtggcaaagcaaaagttcagaatcaccaactggtccacctacaacaaagctctcatcaaccgtggctccctcactttctggctggatgatgaggcgattcaggcctggtatgagtcggcaacaccttcatcacgaggaaggccccagcgctattctgatctcgccatcaccaccgttctggtgattaaacgcgtattccggctgaccctgcgggctgcgcagggttttattgattccatttttgccctgatgaacgttccgttgcgctgcccggattacaccagtgtcagtaagcgggcaaagtcggttaatgtcagtttcaaaacgtccacccggggtgaaatcgcacacctggtgattgattccaccgggctgaaggtctttggtgaaggcgaatggaaagtcagaaagcacggcaaagagcgccgtcgtatctggcgaaagttgcatcttgctgtggggatcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccatgtttgacagcttatcatcgaagcttttcgcaatgtaaccagccaggaagcccgcaataataccaccaatgaagccagaaccggtgctgaccgccagcataccgccaatcagacccggagtgaggcccggacgatcggcaatggaaaaggcaatataacctgccagtaccggcaccatcagcgcaaaggctgaaccaccaccaatctgcatcagcgccgcagccaacgtacccggctctttaaacgcttcgataccaaaagcaaaagaaagcgcgatacacagaccacctgcaacgaccatcggcagcatgtaagaaacgcccgtcagcaagtgacggtatgcgcctgcactctctttcttactttcagtggtcgccgtttgagctttgcccgccggttcatacggcgttgcttcagcaaccgctttatccagttcctgcgcggttttcttcagcgccagaccggtagaggtacgatacatcggtttaccagcaaatttcgccagatccacttcgatatctgccgccacaatcaccagatccgctgctgcgacttcttcgggagtgattgcattacccgcgccaacagaaccacgggtttcaactttcacccaccagccacgttttttcgcttcggtttcaatggcttcagccgccataaaggtgtgtgctacgccagtcgggcaagcagtcaccgcaactacgcgtttcggaccgctggcggcaactggtgctgtcgcagcgaccggcgcagtgtaaggtttcgcatggcctttggcttcactcaggaacagctcttagatcttagtcgacgttaggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccagtgtaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaatagacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagtaatggtattgaccagcatggtacctggacgagcatgcaggccgtgttcattgcgcaccacaaactccgcgcttaacacgtcgtcggtcggcgcatcatcgctggtcagcagcgccagcaacgttgccgcatccgctttcagcaagcggtcagctttattgtcgagcaataaatcagcgagacgcttaagaaccgcgatgggctgatcgtcattcatcgccacactcaccagcatggctgccgtttcgccgtccacatcaaaagcatttgccgcacggcttaccgcaatcgcgctacgcagattgccttcggcgctatcgctcagccagataccctgtccgagattcagcggttgttcattgatggctttggtgacgaaagtggcgtcaactgcccccgcctctttcagacgcgcagcgttcagcgcctgaagagtcagcagatcgctggcgacgatatccagtgtcagcatttcgttgtcgagcttcagctgctcactctgcttttcgcccatcagtaatgcgcgaagttcttctgctgttgttgctgacttcagttgttcagcaacggaatcatcgctcagtacgtgggtcagctggcgtagcaggcccagatgttcatccgagctggcagcaataccgattgccacgtacgctacctgaccgtcaccccaggtgacgccttccgggaactgaaatacctgaacgccggttttcagcacctgatcgcgggtgtcggtagtgccgtgtggaatagcaataccattgccgaggaacgttgaggtttgctgttcgcgcgccagcatgccattgacgtagccttctgcttattagcggccgctaatgaatcggccaacgcgcggggagaggcggtttgcgtattggcaccattccttgcggcggcggtgctcaacggcctcaacctactactgggctgcttcctaatgcaggagtcgcataagggagagcgtc

SEQ ID NO: 171 - DNA, 15084 bp, Artificial Sequence
  synthetic plasmid pBR1100
gatccccgacagtaagacgggtaagcctgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcatttaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcgaacttttgctgagttgaaggatcagatcacgcatcctcccgacaacacagaccattccgtggcaaagcaaaagttcagaatcaccaactggtccacctacaacaaagctctcatcaaccgtggctccctcactttctggctggatgatgaggcgattcaggcctggtatgagtcggcaacaccttcatcacgaggaaggccccagcgctattctgatctcgccatcaccaccgttctggtgattaaacgcgtattccggctgaccctgcgggctgcgcagggttttattgattccatttttgccctgatgaacgttccgttgcgctgcccggattacaccagtgtcagtaagcgggcaaagtcggttaatgtcagtttcaaaacgtccacccggggtgaaatcgcacacctggtgattgattccaccgggctgaaggtctttggtgaaggcgaatggaaagtcagaaagcacggcaaagagcgccgtcgtatctggcgaaagttgcatcttgctgtggggatcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccatgtttgacagcttatcatcgaagctttccatttcgctggtggtcagatgcgggatggcgtgggacgcggcggggagcgtcacactgaggttttccgccagacgccactgctgccaggcgctgatgtgcccggcttctgaccatgcggtcgcgttcggttgcactacgcgtactgtgagccagagttgcccggcgctctccggctgcggtagttcaggcagttcaatcaactgtttaccttgtggagcgacatccagaggcacttcaccgcttgccagcggcttaccatccagcgccaccatccagtgcaggagctcgttatcgctatgacggaacaggtattcgctggtcacttcgatggtttgcccggataaacggaactggaaaaactgctgctggtgttttgcttccgtcagcgctggatgcggcgtgcggtcggcaaagaccagaccgttcatacagaactggcgatcgttcggcgtatcgccaaaatcaccgccgtaagccgaccacgggttgccgttttcatcatatttaatcagcgactgatccacccagtcccagacgaagccgccctgtaaacggggatactgacgaaacgcctgccagtatttagcgaaaccgccaagactgttacccatcgcgtgggcgtattcgcaaaggatcagcgggcgcgtctctccaggtagcgaaagccattttttgatggaccatttcggcacagccgggaagggctggtcttcatccacgcgcgcgtacatcgggcaaataatatcggtggccgtggtgtcggctccgccgccttcatactgcaccgggcgggaaggatcgacagatttgatccagcgatacagcgcgtcgtgattagcgccgtggcctgattcattccccagcgaccagatgatcacactcgggtgattacgatcgcgctgcaccattcgcgttacgcgttcgctcatcgccggtagccagcgcggatcatcggtcagacgattcattggcacttagatcttagtcgacgttaggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccagtgtaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaatagacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgcctcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagtttcgggttttcgacgttcagacgtagtgtgacgcgatcggcataaccaccacgctcatcgataatttcaccgccgaaaggcgcggtgccgctggcgacctgcgtttcaccctgccataaagaaactgttacccgtaggtagtcacgcaactcgccgcacatctgaacttcagcctccagtacagcgcggctgaaatcatcattaaagcgagtggcaacatggaaatcgctgatttgtgtagtcggtttatgcagcaacgagacgtcacggaaaatgccgctcatccgccacatatcctgatcttccagataactgccgtcactccagcgcagcaccatcaccgcgaggcggttttctccggcgcgtaaaaatgcgctcaggtcaaattcagacggcaaacgactgtcctggccgtaaccgacccagcgcccgttgcaccacagatgaaacgccgagttaacgccatcaaaaataattcgcgtctggccttcctgtagccagctttcatcaacattaaatgtgagcgagtaacaacccgtttattagcggccgctaatgaatcggccaacgcgcggggagaggcggtttgcgtattggcaccattccttgcggcggcggtgctcaacggcctcaacctactactgggctgcttcctaatgcaggagtcgcataagggagagcgtc

SEQ ID NO: 172 - DNA, 14763 bp, Artificial Sequence
  synthetic plasmid pBR1101
gatccccgacagtaagacgggtaagcctgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcatttaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcgaacttttgctgagttgaaggatcagatcacgcatcctcccgacaacacagaccattccgtggcaaagcaaaagttcagaatcaccaactggtccacctacaacaaagctctcatcaaccgtggctccctcactttctggctggatgatgaggcgattcaggcctggtatgagtcggcaacaccttcatcacgaggaaggccccagcgctattctgatctcgccatcaccaccgttctggtgattaaacgcgtattccggctgaccctgcgggctgcgcagggttttattgattccatttttgccctgatgaacgttccgttgcgctgcccggattacaccagtgtcagtaagcgggcaaagtcggttaatgtcagtttcaaaacgtccacccggggtgaaatcgcacacctggtgattgattccaccgggctgaaggtctttggtgaaggcgaatggaaagtcagaaagcacggcaaagagcgccgtcgtatctggcgaaagttgcatcttgctgtggggatcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccatgtttgacagcttatcatcgaagcttagactcacccagataagtcggggtcagtttttcacgatccagcatcgcctgaacgtattccggctcaacgtaaccgcctttcaccagctgctcgccagcaaaacgaatcgcttcttctttggttgccgctttgcgaccgaggaagatgttctccgcgcctagcttgaacaggttagcactggaatcgtcaaagctgtctttcaggctgtcttttactttctcttcgtttgccgtgtggcgttgggcagcaaccagacgttcggtcaggctggtgtacaggccgctgtcgaggaagttggtcagcgaaatatgctgtgcctgcggaacctggcgcatagcgcgttcggtcaggtcacggtgagtgatgacgaggtccacatctggcggcaggttgttgatcgcgctgttagtaacagaaatctgcgacagacctgcatcctgaattttcttacgcagaacgcctgcgcccatcgcactggaacccataccggcgtcacaggcaacgatgattttacgtacgtggctcaggtcgttagtcacatcgccagcagacagcggagatgcgcctttagactcagctttcatgtcctgcatacgacgagttgctgcttcaatatcatcttcttctttcactttgctggttttcagcaaaatagcagagacaacgaaggagacagccatcgccgcacacacacccgcgatgttagcgaagtaagcaccttttggtgtcatcgcttagatcttagtcgacgttaggcgcgccagagctcatcgttaatgtcttcgtgcgccgtcagtcggcgcacgttttttctctctggtaccgtgtcactgatctagtcaattactcgaagtatccacaagtgaagcatactaagtaatgtacaagaatcaaaaaaatcggctacgcaagtcgcgtagccgaatcatttaaggatccagtgtaatcgattgatagatttaaataagaactgcagaagctagcttagatgctcgtgaaattgacgtgggcgctttgcagggccgtcttaatggcgttggtgtccacgaggatcgagtcgggtgcggaaaacggacggttcttgttggtgaaatcgctgttaccaatgtacagcgattccttgttacgcagcgcctggatgtgccagcgggaccacgaatcccaatacttctggcgatccggcgagataccttggctggtgtagccggtcgtcgggctgttcatcaacgagtcggtgcggtgcgagcccagcgtcagcggcaacttgatccgatgcaccgtggaatcgccgaagatcagcttcagacgcgcgataaattcgctatccgcacccgttttcacacaatcccagacaccggccttctgcaagacgtcggcacggcgaaacaggagcgacgacggattcagacgcttcaaggggtacactgcgcgggcatagaaaataccgttgtcttgcaggcgcacccagtccgagatggagcagatgagcttcggattgagcaacaagggggagatttggcggaacagcttttccggatggctccagtcatccgaatcgtggcaggtgacgaactcgcccttcgcttggatcaagccgatacgcttcgcggcataggtgccgacattctgcggcaggctaatgatcttgatgcgcgtgtctttgagggcgagccgctggagacgaaacagggtgtcatcggtgctcgcgtcatccacaatgatcagctcgaaggaacggtaggtctgattgaggagcgaaatcaccgcattttccacgcggcgacccgtattataggtggtcatcaggatggagatcaacggccccgtctgggccgggtacgggatgctggtgatgatgttgcacggggagagcggggagctgttgtccgtcaaggccacggggctgaggccgaagtatttatagtattcattcagccgattcaggctaatttcggcggtttcgcggaaggcgttattttgcagcagcaggatatccgggctatagacgatatcggatgcgtcgatctgggcgagggtcgagatggccttttgggtcaggccgatccggagttgcagtgcggtatacaggtccagcgggcagttgtccacgttgtccaacaggctcaggctaaaggtcggcgagtaggacgccagggttttcgccagttccactttctgatgggtatcggtgaactcgtccttgaactccatcagcagctcgggcgtcaggctgatgtcgccgcaggcgatttttgcgatcttgattgccagtttgcagcgccaatcggacggggtatccgtcaagttatgcagcgaccagtacatattcagacgatacatcgcgaggatgcgtttcgactgccagaaccggcaatcatcctggatggccgcgagcgcgtggacgtagcggctctttttgagcagccacaagaatttgagattattgaacatttattaacctcctgctagcaacttaagttacgaatcgacgccgaacaggtcgcgggtgtagactttctccgagacatcttccagttcgctggtgcggcgattcgccacaatgacatcgacgcgctccttaaaggaattgatgtcgcgctcgacgtaggaaccgaagaagtagggttctttcaggaccggctcgtacaccacaatctcgatacccttggccttcaaacgtttcatgaccccctggatgctgctggcccggaaattgtcgctacccgccttcatgatcaggcgatagataccgaccactttgggcttacgggacaggatgtcctcggccacgaagtccttacgggtcgtattcgcatccacgatggcctggatcaggttttgcgggacgtcgcgataattggccaacagctgcttcgtatccttcggcagacagtaaccgccgtagccgaaggacgggttgttgtaatgttgaccaatgcgcggatcgagggagacgccttcgatgatttgtttggtatccaggccgtgcacgctcgcgtaggtgtccagctcgttaaagtacgcgatacgcatcgccagatacgtgttcgcgaacagtttgatggcttctgcctcgggcgaatccgtcagcaggatcggaatatcctttttgatggcaccttccgacaggagttcggcgaacttccgtgcgcgttccgacgattcgcccacgacaatgcggctcggatagagattatcatacagggctttgccttcgcgcaggaactccggggaaaagatgatattattcgtgttcagatcgcgcttcaggcgttcggtgaacccgacggggacggtggatttgataatgatggtcgcgttcgggttaatggacagcacgtcacacgcgacgctttcgacgctcagggtatcaaagttgttattaatcggatcatagttcgtcggggtggcgatgatcacgtagtctgcatcgcgatatgcctcgtatttttccgtcgtcgcgtagaggttcagcttacgattggagagaaacttctggatttccgggtcgcaaatcggcgagattttcttgttaatgagctggaccttcttcgggtcgatgtccagggcgatgatgtcgtgtttttgggagaggaggatcgcaatgctgatacccacatagccgacgccggccacggcaattttcatttattaacctccttaagtgaattcaaactagtttacaagtcgttttcgatcttctcccaggtatatttgcgacattcattcaagttggtcagcggcgagtatttgtactttttgataccgaggcgcgacaggctttcgttcaccaccttgaaatggttttccttttggatgtccagtttcttgatcgacgtgttctcgccgtgcaggacacggttgtagcaaatcttattgatatgcttaaacgggccgacttcgctgagtttcaaatacatatcgtaatccaccgcattgctgatgctctcgttgaagccttcggtgaggttccatgcacgcgccgtgaacatacggaagtggtggcagatcatcgcgctcgtgagcttttcgcggctgtaaatcggccagttgtagccattgctaatcaagttaccttcacgatcaatattgcgattggtggtgtacacgcaggcgaggctcaggtctttgcgaaattcatccagacacagttccacggcatcgggctccaggaaatcatcggaatccagctgcccgatgtagaaaccccggcacaggcggactgcggtattcgaggcggagccgatgcctttgtttttctggctgatgaaacggacgcgcgggtggtttgcgtaatgttcttgcaggatgcgcagcgtatcatcggtgctcccgtcatcgcagatgcagacctccagatcggtgatcgtttggttcagtgccgattcgacgcagcgcacgatatatttgctgcaattatacgcggggatgtagatgctcaccaggggcacacgtttcagggtggcgctctcgattttctccttcttgcgataaaagtagggcaccttctgctgcaacagctggacggtaatgtttttacctgccgcgcgatcggtttcgttctccttaccgggcggttcctgatgatatgccatcgcgccttccacgctacggaaataacaaccctcgcggtacagccgatagccgaactcattatcctcaccgccccaatgcgtgaactcttcgtcaaaccaacccgcgcgaaacagccacttctttgcaaacgccacattgccaccgctaaagaaccggaacggggtgttgcacaggcgcagattgtcggtattcttgaaatgttcgatgcgccaatcgacggatttgttctgctcgaccttgcctgcgacctgattattggtaataatctccgggatttcattgatcaggcttttctgggacaaaaagtccagataggtatgcttcgacgtgtcgatgtatttacgcgggccaatcagtgccacgttatcatccacggccaggagttccatataggactgcacccacaacgggttcggcgccatatcgcagtccaagatcgccacgtagttgtatttcgctgcccgcaggcccaggttccgcacggcgcacagctggtagccgtagtctttctggcggacgtatttgatgttcagcaacgactcgaactcgcggacgatctcttcgatgttttccttggaaccgtcatccgcgacgatgacctcatagtcataaatcgttttctgattgcagaggcaggccagggtgatcgccaggattttggcgcgattgtacgtcggaatcacgatggacaggccgtcgatgatcagttgcttgcgcggataatcatccagttctttacgtttccctgcccagacgtagtcgttcgtgctttccggcagcggcggcaaggtcaggtcgctcggccaatccagcggaatgggttcgacttctttcaattcggcgcgctcggatttctttgcggtaatttcccgatatttgctaatgatttcattcttttccacctcattcagcgagatcgcctttgcattgctgcacataattttggttgccgcgtcgatatcaatgaccgctttccgattcagcttgtccacttcttcgctcagattcagggcggtttggcacagcttgatattggcttccacccagctcacatcatagatttccgccactttttcaaacagggagagggcttggcggtagttcttattcttatacagattgattgcctggttcaaaatgctcatttattaacctcctactagtgaattttcgaattacttaccgcagtacttgacacccacctgggaattgtttttggtgcgtttgaattggcggatggtacggtagatgctaaagggcaggctgatcagaccgagcggaaaattgttcttattgatgatgagcttgcccagctgatagctcaggtgtttcttgacccgttcggcttcgtgtttatccgcgtacaggaagatgctcggcaggctcacttggtactccgaatcatatttcttcttccaggtccgccattcgctgatcaacgcaaacggaatcgagatcagaccgaggaacgtcttggagcggctcaccatcaccgcacccaggcggtagccgatatcttgcttgatgcgttcggccgcaccatacagctccggcagttgtttcttttcgagacgttgattgtcgatgaagtactgttcgagcttttgctgcaccagatgcagctgattgagcagcaattctttttcgcacgacagcttttcgaggcgctgttgttgcagttcatttttgttctgttcctttttcagcagggactcgaagttctcgatcgcgcactccagttcctggacctggatggttttgtttttaatgatcagatcatactggatcagttcttccttgctatccgacagctctttcagaatggcttgataggcgttcagctgtttggacgtgtgcagttcgttgtccagaatgatctttttgctgctctggtacagaccgttcacgatatcgagggtgatctggcgttgtttaatgaacgtctcccaaataaaggacggcttatagttttccttctccagcacccgcaagggggtgttggcgttcgattgcaattcaaagtacagttccttgcaatcgggatagtcgttcaggacgttgaagatcaagtactcctccgtctcgctttgcttgaaaatgatatccccggtcccgatgtcaataccgctgagggacatgatctcctgatgttctttttccagcgtaatggaggcttcggcggtcttaaagtcattcacgctctgctccagcgagtggttgatggtattggagaacgacaacccgaatttcagtttcagtttgtgttgcagttgctggatgcagtcctcggcgttgcgcttcacctgttcgctcgacaccagcaggcaccgaccccggttgttgaggaagaagtgcagcaaggcggtgttgtatgccagccagtttttgatcagatgctccgaggtatagttgctggagatgttctggtccgagaagtagttcgtcaggatgcttttggggtggtcgtagatgaggataaaggtgatgttctcatccaccgatttccaatattccaacgtgtgaattgcgttggggtcgctccaaccgcacagtttctggttcaggttggacagcatcagatccaatgcgataccgttccagacggtgctcacatggagcggttcaaagtcggcggaatcggtcaccgtatagatgtccggcgactggtacgccttccgcagcgtctgggtgatgtcctggggcgagaggttctcacgtttggacgggcacagggagttcatgccgcgctgatgcaggagttcttccacgatttggtagttgctgctcggatggcccacgatcaccaggcggttcatttattaacctcctttcgaaaatgaacggtccgttaaatatagccattcggattcttcatctgccagcgccaggcgtcctccagcatggtttcgagttcccgcttggctttccagttcagatatttgttggccttttcgggggaggaccagctctccgcgatatcaccgtcacggcggctcacgatttcatacggaatccgcacgccggaaatcttttcaaaggtggacaccagttccagcaccgaataacctttacccgtgcccaaattaaagacgtggtagttggtgttattgtcgcggaagagataggacagcgctgcgacgtgcccttcggccaggtccatcacatggatatagtcacggacccccgtgccgtctttggtgggataatcaccaccgaacaccatcagtttttccagtttccccatcgcgacctgcaagatgtacggcaccaagttggaggggatgtctgccgggctttcaccaatcataccggattcgtgggcgcccgtcggattaaagtagcgcaagcagaggaaattcgtgtcggagtatttcttggcgatgtcgcggatcatcagctccgagatgtacttggacgtaccatacggattcagcgtgccaccaatatggcagtcttcggtgacgggcatgatcttgctttccccatacaccgtcgccgacgagctaaagatgaagttggcgacgtcgttcttgatggcgcaattgatgagttgcagggtgccgctcacgttgttgtcatagtagaagatgggcttgatcaggctttctgcgaccgatttcgcacctgcaaagtgcatgatgcagtcgaatttgtgtttcttcaggatctggttcacttccttctcgttgttgatattgagttcgtagaacgtgactttcttctttgcgatcagctcaatgcgacggatgctttcgcagctgctgttgatgagattgtcaatgatgacgacattgtagcctttgttcagcaggcagagcgacgtgtggctgccgatgtagcctgcaccgccggtgaccaggatgttcatttattaacctcctcggtccgaattaacctaggttatgaggtcagcattgcttcttcacgcggtgttaattaatagacctgcaggattattgtttctgttgcataaagcctaaggggtaggcctttctagagatagccattttttgcactcctgtatccgcttcttgcaaggctggacttatccctatcaaaccggacactgcaggctgacaagctttcattacatatgaagagtttgtagaaacgcaaaaaggccatccgtcaggatggccttctaagaaggctcgagcagtacagcaaggatagaacccggagatgccggagaaaccagaccaccgcccaggatagtcagcgtgaacacgccagtcataccgccgaggatgactgcgaggatcagacgcggattcatcagcacatacgggaagtagatttcgtggataccccccaggaagtggatgattgccgcaccgcccgcagactgtttagcgctaccacgaccaaagaacatgtacgccagcagcacgcccatacctggacctgggttagcttcaatcaggaagaagattgatttacccagttcatgggactgctgaatacccagcggcgagaagataccgtggttaatggcgttgttgaggaacaggattttcgccggttcaacaaagatagacgccagcggcagcatgtcatggacaaccatgaagttaacgcccgcagccagcattttggacagggcttcaacaatcgggccaatgccgaggaatgccagaatagcgaggatcatcccgatgatgcctgcggagaagttattcaccagcatctcaaaaccggatttgatcttaccgtctacccagcggtcgaagtgcttaatgcaccagccgcccagcggacctgcaatcatagaaccgaggaacatcggcatgtctgcgccgacgataacgcccatggtggtgatggcaccgactacgccgccacgttcgccgcctaccagcttaccaccggtataaccgatcagcagcggcaggagataagtgatcatcggcccgaccagcttcgccagcgtctcgttcggtaaccaccctgttggaatttattagcggccgctaatgaatcggccaacgcgcggggagaggcggtttgcgtattggcaccattccttgcggcggcggtgctcaacggcctcaacctactactgggctgcttcctaatgcaggagtcgcataagggagagcgtc

SEQ ID NO: 173 - DNA, 29 bp, Artificial Sequence
  synthetic primer BLR513
tcatcaagcttgtccggaagtgatgaccc

SEQ ID NO: 174 - DNA, 30 bp, Artificial Sequence
  synthetic primer BLR516
gtagcctcgagcatggtggcgttgtcgatg

SEQ ID NO: 175 - DNA, 5859 bp, Artificial Sequence
  synthetic plasmid pBR1103
gatccccgacagtaagacgggtaagcctgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcatttaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcgaacttttgctgagttgaaggatcagatcacgcatcctcccgacaacacagaccattccgtggcaaagcaaaagttcagaatcaccaactggtccacctacaacaaagctctcatcaaccgtggctccctcactttctggctggatgatgaggcgattcaggcctggtatgagtcggcaacaccttcatcacgaggaaggccccagcgctattctgatctcgccatcaccaccgttctggtgattaaacgcgtattccggctgaccctgcgggctgcgcagggttttattgattccatttttgccctgatgaacgttccgttgcgctgcccggattacaccagtgtcagtaagcgggcaaagtcggttaatgtcagtttcaaaacgtccacccggggtgaaatcgcacacctggtgattgattccaccgggctgaaggtctttggtgaaggcgaatggaaagtcagaaagcacggcaaagagcgccgtcgtatctggcgaaagttgcatcttgctgtggggatcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgaaagcaaattcgacccggtcgtcggttcagggcagggtcgttaaatagccgcttatgtctattgctggtttaccggtttattgactaccggaagcagtgtgaccgtgtgcttctcaaatgcctgaggccagtttgctcaggctctccccgtggaggtaataattgacgatatgatcatttattctgcctcccagagcctgataaaaacggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccatgtttgacagcttatcatcgaagcttgtccggaagtgatgacccaggcgctgaaagtgctggatgccgtgcgcaaccgctttgcgatgcgcatcaccaccagccattacgatgtaggcggcgcagccattgataaccacgggcaaccactgccgcctgcgacggttgaaggttgtgagcaagccgatgccgtgctgtttggctcggtaggcggcccgaagtgggaacatttaccaccagaccagcaaccagaacgcggcgcgctgctgcctctgcgtaagcacttcaaattattcagcaacctgcgcccggcaaaactgtatcaggggctggaagcattctgtccgctgcgtgcagacattgccgcaaacggcttcgacatcctgtgtgtgcgcgaactgaccggcggcatctatttcggtcagccaaaaggccgcgaaggtagcggacaatatgaaaaagcctttgataccgaggtgtatcaccgttttgagatcgaacgtatcgcccgcatcgcgtttgaatctgctcgcaagcgtcgccacaaagtgacgtcgatcgataaagccaacgtgctgcaatcctctattttatggcgggagatcgttaacgagatcgccacggaatacccggatgtcgaactggcgcatatgtacatcgacaacgccaccatgctcgagtatgcggccgctaatgaatcggccaacgcgcggggagaggcggtttgcgtattggcaccattccttgcggcggcggtgctcaacggcctcaacctactactgggctgcttcctaatgcaggagtcgcataagggagagcgtc

What is claimed is:

1. A construct comprising a gene cluster comprising kpsF, kpsE, kpsD, kpsU, kpsC, kpsS, kfoA, kfoC, kfoG, and kfoF, wherein the gene cluster does not contain a functional gene of one or more of kfoD, orf3 (kfoI), kfoE, or orf1 (kfoH), and wherein the construct is suitable for producing a chondroitin in a non-pathogenic bacterial host cell.

2. The construct of claim 1, wherein the chondroitin is non-fructosylated.

3. The construct of claim 1, wherein the chondroitin is secreted from the host cell.

4. The construct of claim 1, wherein the gene cluster further comprises kfoB.

5. The construct of claim 1, wherein the gene cluster further comprises kpsM and kpsT.

6. The construct of claim 1, wherein the construct comprises pDD66, pDD67, pCX040, pCX042, pCX096, or pBR1052.

7. The construct of claim 1, wherein one or more genes are modified for optimal codon usage in the bacterial host cell.

8. The construct of claim 1, further comprising a promoter.

9. The construct of claim 8, wherein the promoter is selected from the group consisting of Pm, Plac, Ptrp, Ptac, λpL, PT7, PphoA, ParaC, PxapA, Pcad, and PrecA.

10. The construct of claim 9, wherein the promoter is Pm.

11. The construct of claim 1, wherein the construct further comprises a second promoter.

12. The construct of claim 11, wherein the second promoter is selected from the group consisting of Pm, Plac, Ptrp, Ptac, pL, PT7, PphoA, ParaC, PxapA, Pcad, and PrecA.

13. The construct of claim 12, wherein the second promoter is Pm.

14. The construct of claim 11, wherein the second promoter is operably linked to one or more genes.

15. The construct of claim 14, wherein the second promoter is operably linked to kpsFEDUCS.

16. The construct of claim 1, wherein the construct further comprises a xylS regulatory gene.

17. The construct of claim 1, further comprising an antibiotic resistance gene.

18. The construct of claim 17, wherein the antibiotic resistance gene is selected from the group consisting of chloramphenicol (CamR), kanamycin (KanR), ampicillin (AmpR), tetracycline (TetR), bleomycin (BleR), spectinomycin (SpcR), sulfonamide (SuR), streptomycin (StrR), carbenicillin (CbR), and erythromycin (EryR).

19. The construct of claim 1, comprising a K4 gene cluster.

20. The construct of claim 1, wherein the bacterial host cell is or is derived from a non-pathogenic organism selected from the group consisting of *Escherichia*, *Pseudomonas*, *Xanthomonas*, *Methylomonas*, *Acinetobacter*, and *Sphingomonas*.

21. A non-pathogenic bacterial host cell comprising the construct of claim 1.

22. The non-pathogenic bacterial host cell of claim 21, wherein the bacterial host cell is a bacterial strain selected from the group consisting of MSC279, MSC280, MSC315, MSC316, MSC317, MSC319, MSC322, MSC324, MSC326, MSC328, MSC346, MSC347, MSC348, MSC350, MSC356, MSC359, MSC392, MSC402, MSC403, MSC404, MSC405, MSC410, MSC411, MSC436, MSC437, MSC438, MSC439, MSC458, MSC459, MSC460, MSC461, MSC466, MSC467, MSC469, MSC480, MSC494, MSC498, MSC499, MSC500, MSC510, MSC511, MSC522, MSC526, MSC537, MSC551, MSC561, MSC562, MSC563, MSC564, MSC566, MSC567, MSC619, MSC625, MSC627, MSC640, MSC641, MSC643, MSC646, MSC650, MSC656, MSC657, MSC658, MSC659, MSC660, MSC669, MSC670, MSC671, MSC672, MSC673, MSC674, MSC675, MSC676, MSC677, MSC678, MSC679, MSC680, MSC681, MSC682, MSC683, MSC684, MSC687, MSC688, MSC689, MSC690, MSC691, MSC692, MSC693, MSC694, MSC700, MSC701, MSC702, MSC722, MSC723 and MSC724.

23. A method for producing a chondroitin, comprising:
   (a) transferring the construct of claim 1 to a non-pathogenic bacterial host cell, and
   (b) culturing the bacterial host cell under fermentation conditions wherein the chondroitin is produced by the bacterial host cell.

24. A method for producing a chondroitin, comprising culturing a non-pathogenic bacterial host cell comprising the construct of claim 1 under fermentation conditions sufficient for production of the chondroitin.

25. A method for producing a non-pathogenic bacterial host cell comprising the construct of claim 1, comprising transferring the construct of claim 1 to a non-pathogenic bacterial host cell.

26. The method of claim 24, wherein the gene cluster or gene of the construct is integrated into a chromosome of the bacterial host cell.

27. The method of claim 26, wherein two or more copies of the gene cluster or gene are integrated into the chromosome of the bacterial host cell.

28. The method of claim 24, wherein the chondroitin is non-fructosylated.

29. The method of claim 24, further comprising sulfating the chondroitin.

30. A method for producing a chondroitin sulfate, comprising:
(a) producing a chondroitin by the method of claim 24, and
(b) sulfating the chondroitin.

31. The method of claim 30, wherein the sulfating comprises mixing sulfurtrioxide-triethylamine complex or chlorosulfonic acid with the chondroitin in formamide.

32. The method of claim 24, wherein the bacterial host cell is or is derived from a non-pathogenic organism selected from the group consisting of *Escherichia, Pseudomonas, Xanthomonas, Methylomonas, Acinetobacter*, and *Sphingomonas*.

33. The method of claim 24, wherein the bacterial host cell is or is derived from a gram-negative organism.

34. The method of claim 32, wherein the bacterial host cell is a *Xanthomonas campestris*.

35. The method of claim 34, wherein the *X. campestris* is a bacterial strain selected from the group consisting of MSC255, MSC256, MSC257, MSC225, and MSC226.

36. The method of claim 32, wherein the bacterial host cell is a non-pathogenic *E. coli*.

37. The method of claim 36, wherein the non-pathogenic *E. coli* is selected from the group consisting of *E. coli* K-12 and *E. coli* B.

38. The method of claim 37, wherein the *E. coli* K-12 is a bacterial strain selected from the group consisting of MSC188 and MSC175.

39. The method of claim 37, wherein the *E. coli* B is bacterial strain MSC364.

40. The method of claim 24, wherein an endogenous gene of the bacterial host cell is deleted or inactivated by homologous recombination.

41. The method of claim 24, wherein the bacterial host cell does not express extracellular polysaccharides endogenous to the host cell.

42. The method of claim 24, wherein the bacterial host cell is suitable for conjugal transfer from a laboratory cloning strain.

43. The method of claim 24, further comprising recovering the chondroitin from the bacterial host cell.

44. The method of claim 24, further comprising recovering the chondroitin from extracellular culture medium.

45. The method of claim 24, wherein 1 g/L to 50 g/L of the chondroitin is secreted from the bacterial host cell in 24 hours to 72 hours.

46. The method of claim 45, wherein 5 g/L to 50 g/L of the chondroitin is secreted from the bacterial host cell in 24 hours to 72 hours.

47. The method of claim 46, wherein 15 g/L to 50 g/L of the chondroitin is secreted from the bacterial host cell in 24 hours to 72 hours.

48. The method of claim 24, further comprising purifying the chondroitin.

49. The method of claim 24, wherein the bacterial host cell is cultured at 25° C. to 37° C.

50. The method of claim 24, wherein the bacterial host cell is cultured in a medium comprising glycerine.

51. The chondroitin produced by the method of claim 24.

52. A composition comprising the chondroitin of claim 51.

* * * * *

UNITED STATES PATENT AND TRADEMARK OFFICE
CERTIFICATE OF CORRECTION

PATENT NO. : 8,697,398 B2  
APPLICATION NO. : 13/038326  
DATED : April 15, 2014  
INVENTOR(S) : Doherty et al.

Page 1 of 1

It is certified that error appears in the above-identified patent and that said Letters Patent is hereby corrected as shown below:

On Title Page 1 in the listing of inventors under Item (75), the residence "Higashiyamato (JP)" for inventors Kentaro Miyamoto and Toshikazu Minamisawa should be corrected to --Higashiyamato-shi, Tokyo (JP)--.

In the Claims
In column 117, line 50, "80 pL" should be replaced with --$\lambda$pL--.

Signed and Sealed this
Twentieth Day of January, 2015

Michelle K. Lee
*Deputy Director of the United States Patent and Trademark Office*